US010188730B2

(12) United States Patent
Liang et al.

(10) Patent No.: US 10,188,730 B2
(45) Date of Patent: Jan. 29, 2019

(54) ANTI-LAG3 ANTIBODIES AND ANTIGEN-BINDING FRAGMENTS

(71) Applicant: Merck Sharp & Dohme Corp., Rahway, NJ (US)

(72) Inventors: Linda Liang, Mountain View, CA (US); Laurence Fayadat-Dilman, Sunnyvale, CA (US); Rene De Waal Malefyt, Sunnyvale, CA (US); Gopalan Raghunathan, San Diego, CA (US)

(73) Assignee: Merck Sharp & Dohme Corp., Rahway, NJ (US)

( * ) Notice: Subject to any disclaimer, the term of this patent is extended or adjusted under 35 U.S.C. 154(b) by 0 days.

(21) Appl. No.: 15/482,355

(22) Filed: Apr. 7, 2017

(65) Prior Publication Data

US 2017/0267759 A1    Sep. 21, 2017

Related U.S. Application Data

(63) Continuation of application No. 15/305,011, filed as application No. PCT/US2015/045481 on Aug. 17, 2015.

(60) Provisional application No. 62/171,319, filed on Jun. 5, 2015, provisional application No. 62/039,081, filed on Aug. 19, 2014.

(51) Int. Cl.
| | | |
|---|---|---|
| *C07K 16/00* | (2006.01) | |
| *A61K 39/395* | (2006.01) | |
| *C07K 16/28* | (2006.01) | |
| *A61K 45/06* | (2006.01) | |
| *A61K 39/00* | (2006.01) | |

(52) U.S. Cl.
CPC ...... *A61K 39/39566* (2013.01); *A61K 39/395* (2013.01); *A61K 45/06* (2013.01); *C07K 16/2803* (2013.01); *C07K 16/2818* (2013.01); *C07K 16/2896* (2013.01); *A61K 2039/505* (2013.01); *A61K 2039/507* (2013.01); *C07K 2317/24* (2013.01); *C07K 2317/32* (2013.01); *C07K 2317/33* (2013.01); *C07K 2317/34* (2013.01); *C07K 2317/41* (2013.01); *C07K 2317/50* (2013.01); *C07K 2317/76* (2013.01); *C07K 2317/92* (2013.01)

(58) Field of Classification Search
None
See application file for complete search history.

(56) References Cited

U.S. PATENT DOCUMENTS

| | | |
|---|---|---|
| 5,773,578 A | 6/1998 | Hercend et al. |
| 5,874,250 A | 2/1999 | Hercend et al. |
| 5,955,300 A | 9/1999 | Faure et al. |
| 5,976,877 A | 11/1999 | Hercend et al. |
| 6,143,273 A | 11/2000 | Pardoll et al. |
| RE38,313 E | 11/2003 | Faure et al. |
| 2011/0070238 A1 | 3/2011 | Triebel |
| 2014/0127226 A1 | 5/2014 | Pardoll et al. |
| 2015/0259420 A1 | 9/2015 | Triebel et al. |
| 2017/0022273 A1 | 1/2017 | Zhou et al. |

FOREIGN PATENT DOCUMENTS

| | | |
|---|---|---|
| EP | 0510079 B1 | 7/1991 |
| EP | 0758383 B1 | 11/1995 |
| EP | 1897548 B1 | 3/2008 |
| EP | 2044949 A1 | 4/2009 |
| EP | 2320940 B1 | 5/2011 |
| EP | 2659893 A3 | 2/2014 |
| EP | 2792365 A1 | 10/2014 |
| WO | WO199110682 A1 | 7/1991 |
| WO | WO199530750 A2 | 11/1995 |
| WO | WO199823741 A1 | 6/1996 |
| WO | WO199703695 A1 | 2/1997 |
| WO | WO1998023748 A1 | 6/1998 |
| WO | WO1998058059 A1 | 12/1998 |
| WO | WO2003031655 A1 | 4/2003 |
| WO | WO2004078928 A2 | 9/2004 |
| WO | WO2008132601 A1 | 11/2008 |
| WO | WO201019570 A2 | 2/2010 |
| WO | WO2011109789 A2 | 9/2011 |
| WO | WO2012177624 A2 | 12/2012 |
| WO | WO2013066761 A1 | 5/2013 |

(Continued)

OTHER PUBLICATIONS

De Pascalis et al. "Grafting of "Abbreviated" Complementarity-Determining Regions Containing Specificity-Determining Residues Essential for Ligand Contact to Engineer a Less Immunogenic Humanized Monoclonal Antibody", The Journal of Immunology, 2002, 169: 3076-3084. (Year: 2002).*

(Continued)

*Primary Examiner* — Michail A Belyavskyi
(74) *Attorney, Agent, or Firm* — Li Su; Laura M. Ginkel

(57) ABSTRACT

The present invention includes antibodies and antigen-binding fragments thereof that specifically bind to human or cynomolgous monkey LAG5 as well as immunoglobulin chains thereof and polynucleotides encoding the same along with injection devices comprising such antibodies or fragments. Vaccines including such antibodies and fragments as well as compositions comprising the antibodies and fragments (e.g., including anti-PD1 antibodies) are included in the invention. Methods for treating or preventing cancer or infection using such compositions are also provided. In addition, methods for recombinant expression of the antibodies and fragments are part of the present invention.

41 Claims, 19 Drawing Sheets
Specification includes a Sequence Listing.

(56) References Cited

FOREIGN PATENT DOCUMENTS

| WO | WO2013079945 A1 | 6/2013 |
|---|---|---|
| WO | WO2013192215 A1 | 12/2013 |
| WO | WO201408218 A1 | 1/2014 |
| WO | WO2014028560 A2 | 2/2014 |
| WO | WO2014030049 A2 | 2/2014 |
| WO | WO2014030052 A2 | 2/2014 |
| WO | WO2014140180 A1 | 9/2014 |
| WO | WO2014144791 A2 | 9/2014 |
| WO | WO2014163684 A1 | 10/2014 |
| WO | WO2014179664 A2 | 11/2014 |
| WO | WO2014209804 A1 | 12/2014 |
| WO | WO201516718 A1 | 2/2015 |
| WO | WO2015042246 A1 | 3/2015 |
| WO | WO2015048312 A1 | 4/2015 |
| WO | WO2015069571 A1 | 5/2015 |
| WO | WO2015069770 A1 | 5/2015 |
| WO | WO2015085210 A1 | 6/2015 |
| WO | WO2015091970 A1 | 6/2015 |
| WO | WO2015092382 A1 | 6/2015 |
| WO | WO2015112534 A2 | 7/2015 |
| WO | WO2015116539 A1 | 8/2015 |
| WO | WO2015138920 A1 | 9/2015 |
| WO | WO2015200119 A1 | 12/2015 |
| WO | WO2015200828 A1 | 12/2015 |
| WO | WO2016123285 A1 | 8/2016 |
| WO | WO2016126858 A2 | 8/2016 |
| WO | WO2016168716 A1 | 10/2016 |
| WO | WO2016200782 A1 | 12/2016 |
| WO | WO2017019894 A1 | 2/2017 |

OTHER PUBLICATIONS

MacCallum et al., "Antibody-antigen Interactions: Contact Analysis and Binding Site Topography", J. Mo/. Biol. (1996) 262, 732-745 (Year: 1996).*
Creg J. Workman et al., LAG-3 Regulates Plasmacytoid Dendritic Cell Homeostasis, The Journal of Immunology, 2009, 1885-1891, 182.
Malgorzata Kisielow et al., Expression of lymphocyte activation gene 3 (LAG-3) on B cells is induced by T cells, European Journal of Immunology, 2005, 2081-2088, 35.
Shawn D. Blackburn et al., Coregulation of CD8+ T cell exhaustion by multiple inhibitory receptors during chronic viral infection, Nature Immunology, Jan. 2009, 29-37, 10-1.
Susanne Andreae et al., Maturation and Activation of Dendritic Cells Induced by Lymphocyte Activation Gene-3 (CD223), The Journal of Immunology, 2002, 3874-3880, 168.
Woo et al., Immune Inhibitory Molecules LAG-3 and PD-1 Synergistically Regulate T-cell Function to Promote Tumoral Immune Escape, Cancer Research vol. 72, No. 4 (2011), pp. 917-927.
Grosso JF, Kelleher CC, Harris TJ, Maris CH, Hipkiss EL, De Marzo A, Anders R. Netto G, Getnet D, Bruno TC, Goldberg MV, Pardoll DM, Drake CG. LAG-3 regulates CD8+ T cell accumulation and effector function in murine self-and tumor-tolerance systems, J Clin Invest, Nov. 2007; 117(11):3382-92.
Baixeras E, Huard B, Miossec C, Jitsukawa S, Martin M., Hercend T, Auffray C, Triebel F, Platier-Tonneau D. Characterization of the lymphocyte activation gene 3 -encoded protein. A new ligand for human leukocyte antigen class II antigens. J Exp Med. Aug. 1, 1992; 176(2):327-37.
Demeure CE, Wolfers J, Martin-Garcia N, Gaulard P, Triegel F. T Lymphocytes infiltrating various tumour types express the MHC class II ligand lymphocyte activation gene-3 (LAG-3): role of LAG-3/MHC class II interactions in cell-cell contacts, Eur J Cancer Sep. 2001; 37(13):1709-18.
Freeman GJ, Sharpe AH, A new therapeutic strategy for malaria: targeting T cell exhaustion.Nat Immunol Jan. 19, 2012;13(2):113-5.
Bruniquel D, Borie N, Hannier S, Triebel F, Regulation of expression of the human lymphocyte activation gene-3 (LAG-3) molecule, a ligand for MHC class II, Immunogenetics, Jul. 1998;48(2):116-24.
Haurd B, Prigent P, Pages F, Bruniquel D, Triebel F, T cell major histocompatibility complex class II molecules down-regulate CD4+T cell clone responses following LAG-3 binding, Eur J Immunol. May 1996;26(5):1180-6.
Hannier S, Tournier M, Bismuth G, Triebel F, CD3/TCR complex-associated lymphocyte activation gene-3 molecules inhibit CD3/TCR signaling, J. Immunol. Oct. 15, 1998;161(8):4058-65.
Huard B, Tournier M, Hercend T, Triebel F, Faure F, Lymphocyte-activation gene 3/major histocompatibility complex class II interaction modulates the antigenic response of CD4+T lymphocytes, Eur J. Immunol, Dec. 1994;24 (12):3216-21.
Huard B, Mastrangeli R, Prigent P, Bruniquel D, Donini S, El-Tayar N, Maigret B, Dréano M, Triebel F, Characterization of the major histocompatibility complex II binding site on LAG-3 protein, Proc natl Acad Sci U S A, May 27, 1997;94(11):5744-9.
Sierro S, Romero P, Speiser DE, The CD4-like molecule LAG-3, biology and therapeutic applications, Expert Opin Ther Targets, Jan. 2011; 15(1):91-101.
Miyazaki T, Dierich A, Benoist C, Mathis D, LAG-3 is not responsible for selecting T helper cells in CD4-deficient mice, Int Immunol, May 1996;8(5):725-9.
Triebel F,Jitsukawa S, Baixeras E, Roman-Roman S, Genevee C, Viegas-Pequignot E, Hercend T, LAG-3, a novel lymphocyte activation gene closely related to CD4, J Exp. Med. May 1, 1990:171(5):1393-405.
Triebel F. LAG-3; regulator of T-cell and DC responses and its use in therapeutic vaccination, Trends Immunol, 2003, 32: 225-2263.
Creg J. Workman, Dennis S. Rice, Kari J. Dugger, Cornelia Kurschner and Dario A. A. Vignali, Phenotypic analysis of the murine CD4-related glycoprotein, CD223 (LAG-3) Eur. J. Immunol. 2002, 32:2255-2263.
Creg J. Workman and Dario A. A. Vignali The CD4-related molecule, LAG-3 (CD233), regulates the expansion of activated T cells, Eur. J. Immunol. 2003, 33: 970-979.
Phan et al., PNAS, Cancer Regression and Autoimmunity Induced by Cytotoxic T Lymphocyte-associated antigen for Blockage in Patients with Metastic Melanoma, 2003, pp. 8372-8377.
International Search Report of PCT/US2015/045481 dated Oct. 9, 2015, 14 pages.
Pardoll & Drake, Immunotherapy earns its spot in the ranks of cancer therapy, J. Exp. Med., 2012, 201-209, 209 (2).
Huard et al., Cellular expression and tissue distribution of the human LAG-3-encoded protein, an MHC class II ligand, Immunogenetics, 1994, 213-217, 39.

* cited by examiner

FIG.5A-1

ANTI-LAG3 ANTIBODIES AND ANTIGEN-BINDING FRAGMENTS

This application is a continuation of U.S. application Ser. No. 15/305,011, filed Oct. 18, 2016, a U.S. National Phase application under 35 U.S.C. § 371 of PCT/US15/45481, filed Aug. 17, 2015 which claims priority to U.S. Provisional Patent Application No. 62/039,081, filed Aug. 19, 2014; and of U.S. Provisional Patent Application No. 62/171,319, filed Jun. 5, 2015; each of which is herein incorporated by reference in its entirety.

The instant application contains a Sequence Listing which has been submitted electronically in ASCII format and is hereby incorporated by reference in its entirety. Said ASCII copy, created on Apr. 7, 2017, is named 23791USCNT-SEQTXT-07APR2017 and is 986 kilobytes in size.

FIELD OF THE INVENTION

The present invention relates to anti-LAG3 antibodies as well as use of the antibodies of the present invention in the treatment of diseases such as cancer and infection.

BACKGROUND OF THE INVENTION

LAG3 (CD223) is a cell surface molecule expressed on activated T cells (Huard et al. Immunogenetics 39:213-217, 1994), NK cells (Triebel et al. J Exp Med 171:1393-1405, 1990), B cells (Kisielow et al. Eur J Immunol 35:2081-2088, 2005), and plasmacytoid dendritic cells (Workman et al. J Immunol 182:1885-1891, 2009) that plays an important role in the function of these lymphocyte subsets. In addition, the interaction between LAG3 and its major ligand, Class II MHC, is thought to play a role in modulating dendritic cell function (Andreae et al. J Immunol 168:3874-3880, 2002). Recent preclinical studies have documented a role for LAG-3 in CD8 T-cell exhaustion (Blackburn et al. Nat Immunol 10:29-37, 2009).

As with chronic viral infection, tumor antigen-specific $CD4^+$ and $CD8^+$ T cells display impaired effector function and an exhausted phenotype characterized by decreased production of pro-inflammatory cytokines and hyporesponsiveness to antigenic re-stimulation. This is mediated by cell extrinsic mechanisms, such as regulatory T-cells (Treg), and cell intrinsic mechanisms, such as inhibitory molecules that are upregulated on exhausted, tumor-infiltrating lymphocytes (TIL). These inhibitory mechanisms represent a formidable barrier to effective antitumor immunity.

LAG—is expressed on tolerized TILs suggesting that they contribute to tumor-mediated immune suppression. Inhibition of LAG3 may lead to enhanced activation of antigen-specific T cells from which a therapeutic benefit may be gained. There is a need in the art for high efficacy therapeutic antibodies which antagonize the activity of LAG3 which can be used to generate a robust immune response to tumors.

SUMMARY OF THE INVENTION

The present invention provides an antibody or antigen-binding fragment thereof (e.g., an antibody, an antigen-binding fragment, monoclonal antibodies, polyclonal antibodies, a multispecific antibody, a humanized antibody, an isolated antibody or antigen-binding fragment thereof, a humanized antagonist antibody, a fully human antibody, a chimeric antibody and a camelized single domain antibody) that specifically binds LAG3 (e.g., human and/or *Macaqa fascicularis*, e.g., SEQ ID NOs: 443 or 445) comprising: a heavy chain immunoglobulin variable region having at least 78.99% amino acid sequence identity to amino acids 1-119 of SEQ ID NO: 106; and/or a light chain immunoglobulin variable region having at least 78.38% amino acid sequence identity to amino acids 1-111 of SEQ ID NO: 224.

In an embodiment of the invention, an anti-LAG3 antibody or antigen-binding fragment thereof of the present invention comprises the light and heavy chain immunoglobulin (e.g., heavy and light chain variable domains or heavy and light chain CDRs) of Ab1, Ab2, Ab3, Ab4, Ab5, Ab6, Ab7, Ab8 or Ab9 as set forth herein.

The present invention provides an antibody or antigen-binding fragment thereof that specifically binds LAG3 (e.g., human or cynomolgous monkey LAG3) comprising (a) the CDR1, CDR2, and CDR3 of a $V_L$ domain of an immunoglobulin chain that comprises the amino acid sequence set forth in SEQ ID NO: 7, 17, 27, 37, 57, 59, 61, 63, 65, 101, 126, 130, 132, 136, 138, 208, 210, 224, 226, 228, 230, 232, 241, 257, 259, 261, 263, 351, 369, 371, 373, 375, 401, 403, 405, 426, 427, 450-453 or 459-461; and/or (b) the CDR1, CDR2, and CDR3 of a $V_H$ domain of an immunoglobulin chain that comprises the amino acid sequence set forth in SEQ ID NO: 2, 12, 22, 32, 45, 47, 49, 51, 53, 55, 67, 69, 71, 73, 75, 77, 79, 81, 83, 85, 87, 89, 91, 93, 95, 97, 99, 103, 106, 108, 110, 112, 114, 116, 118, 120, 122, 124, 128, 134, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 212, 214, 216, 218, 220, 222, 234, 235, 237, 239, 243, 245, 247, 249, 251, 253, 255, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 353, 355, 357, 359, 361, 363, 365, 367, 377, 379, 381, 383, 385, 387, 389, 391, 393, 395, 397, 399, 406-419, 434-442, 448, 449, 462, 463 or 464.

The present invention also provides an antibody or antigen-binding fragment thereof that specifically binds LAGS (e.g., human or cynomolgous monkey) comprising (1) a light chain variable domain comprising CDR-L1 that comprises the amino acid sequence: KASQSLDYEGDSDMN (SEQ ID NO: 38); CDR-L2 that comprises the amino acid sequence: GASNLES (SEQ ID NO: 39); and CDR-L3 that comprises the amino acid sequence: QQSTEDPRT (SEQ ID NO: 40); and/or a heavy chain variable domain comprising: CDR-H1 that comprises the amino acid sequence: DYNVD (SEQ ID NO: 33); CDR-H2 that comprises the amino acid sequence: DINPNNGGTIYAQKFQE (SEQ ID NO: 458); and CDR-H3 that comprises the amino acid sequence: NYRWFGAMDH (SEQ ID NO: 35); or (2) a light chain variable domain comprising CDR-L1 that comprises the amino acid sequence: KASQSLDYEGDSDMN (SEQ ID NO: 38); CDR-L2 that comprises the amino acid sequence: GASNLES (SEQ ID NO: 39); and CDR-L3 that comprises the amino acid sequence: QQSTEDPRT (SEQ ID NO: 40); and/or a heavy chain variable domain comprising CDR-H1 that comprises the amino acid sequence: DYNVD (SEQ ID NO: 33); CDR-H2 that comprises the amino acid sequence: DINPNSGGTIYAQKFQE (SEQ ID NO: 456); and CDR-H3 that comprises the amino acid sequence: NYRWFGAMDH (SEQ ID NO: 35); or (3) a light chain variable domain comprising: CDR-L1 that comprises the amino acid sequence: KASQSLDYEGDSDMN (SEQ ID NO: 38); CDR-L2 that comprises the amino acid sequence: GASNLES (SEQ ID NO: 39); and CDR-L3 that comprises the amino acid sequence: QQSTEDPRT (SEQ ID NO: 40); and/or a heavy chain variable domain comprising CDR-H1 that comprises the amino acid sequence: DYNVD (SEQ ID NO: 33); CDR-H2 that comprises the amino acid sequence: DINPNDGGTIYAQKFQE (SEQ ID NO: 457); and CDR-H3 that comprises the amino acid sequence: NYRWFGAMDH (SEQ ID NO: 35); or (4) a light chain variable domain comprising CDR-L1 that comprises the amino acid sequence: KASQSLDYEGDSDMN (SEQ ID NO: 38); CDR-L2 that comprises the amino acid sequence: GASNLES (SEQ ID NO: 39); and CDR-L3 that comprises the amino acid sequence: QQSTEDPRT (SEQ ID NO: 40); and/or a heavy chain variable domain comprising: CDR-H1 that comprises the amino acid sequence: DYNVD (SEQ ID NO: 33); CDR-H2 that comprises the amino acid sequence: DINPNQGGTIYAQKFQE (SEQ ID NO: 455); and CDR-H3 that comprises the amino acid sequence: NYRWFGAMDH (SEQ ID NO: 35); or (5) a light chain variable domain comprising CDR-L1 that comprises the amino acid sequence: KASQSLDYEGDSDMN (SEQ ID NO: 38); CDR-L2 that comprises the amino acid sequence: GASNLES (SEQ ID NO: 39); and CDR-L3 that comprises the amino acid sequence: QQSTEDPRT (SEQ ID NO: 40); and/or a heavy chain variable domain comprising: CDR-H1 that comprises the amino acid sequence: DYNVD (SEQ ID NO: 33); CDR-H2 that comprises the amino acid sequence: DINPNGGGTIYAQKFQE (SEQ ID NO: 454); and CDR-H3 that comprises the amino acid sequence: NYRWFGAMDH (SEQ ID NO: 35).

In an embodiment of the invention, the antibody or antigen-binding fragment thereof that specifically binds LAG3 (e.g., human or cynomolgous monkey LAG3) comprises the CDRs of various light and/or heavy chain variable regions and having at least 90% overall amino acid sequence identity to the variable region, i.e., variability in the chain occurs outside the CDRs, e.g., (1) a light chain immunoglobulin comprising CDR-L1, CDR-L2 and CDR-L3 of the immunoglobulin comprising the amino acid sequence of SEQ ID NO: 126 or amino acids 21-131 thereof, and having at least 90% amino acid sequence identity to the amino acid sequence set forth in SEQ ID NO: 126 or amino acids 21-131 thereof, and/or a heavy chain immunoglobulin comprising CDR-H1, CDR-H2 and CDR-H3 of the immunoglobulin comprising the amino acid sequence of SEQ ID NO: 106 or amino acids 1-119 thereof, and having at least 90% amino acid sequence identity to the amino acid sequence set forth in SEQ ID NO: 106 or amino acids 1-119 thereof; (2) a light chain immunoglobulin comprising CDR-L1, CDR-L2 and CDR-L3 of the immunoglobulin comprising the amino acid sequence of SEQ ID NO: 126 or amino acids 21-131 thereof, and having at least 90% amino acid sequence identity to the amino acid sequence set forth in SEQ ID NO: 126 or amino acids 21-131 thereof, and/or a heavy chain immunoglobulin comprising CDR-H1, CDR-H2 and CDR-H3 of the immunoglobulin comprising the amino acid sequence of SEQ ID NO: 108 or amino acids 1-119 thereof, and having at least 90% amino acid sequence identity to the amino acid sequence set forth in SEQ ID NO: 108 or amino acids 1-119 thereof; (3) a light chain immunoglobulin comprising CDR-L1, CDR-L2 and CDR-L3 of the immunoglobulin comprising the amino acid sequence of SEQ ID NO: 126 or amino acids 21-131 thereof, and having at least 90% amino acid sequence identity to the amino acid sequence set forth in SEQ ID NO: 126 or amino acids 21-131 thereof, and/or a heavy chain immunoglobulin comprising CDR-H1, CDR-H2 and CDR-H3 of the immunoglobulin comprising the amino acid sequence of SEQ ID NO: 110 or amino acids 1-119 thereof, and having at least 90% amino acid sequence identity to the amino acid sequence set forth in SEQ ID NO: 110 or amino acids 1-119 thereof; (4) a light chain immunoglobulin comprising CDR-L1, CDR-L2 and CDR-L3 of the immunoglobulin comprising the amino acid sequence of SEQ ID NO: 126 or amino acids 21-131 thereof, and having at least 90% amino acid sequence identity to the amino acid sequence set forth in SEQ ID NO: 126 or amino acids 21-131 thereof, and/or a heavy chain immunoglobulin comprising CDR-H1, CDR-H2 and CDR-H3 of the immunoglobulin comprising the amino acid sequence of SEQ ID NO: 112 or amino acids 1-119 thereof, and having at least 90% amino acid sequence identity to the amino acid sequence set forth in SEQ ID NO: 112 or amino acids 1-119 thereof; (5) a light chain immunoglobulin comprising CDR-L1, CDR-L2 and CDR-L3 of the immunoglobulin comprising the amino acid sequence of SEQ ID NO: 126 or amino acids 21-131 thereof, and having at least 90% amino acid sequence identity to the amino acid sequence set forth in SEQ ID NO: 126 or amino acids 21-131 thereof, and/or a heavy chain immunoglobulin comprising CDR-H1, CDR-H2 and CDR-H3 of the immunoglobulin comprising the amino acid sequence of SEQ ID NO: 114 or amino acids 1-119 thereof, and having at least 90% amino acid sequence identity to the amino acid sequence set forth in SEQ ID NO: 114 or amino acids 1-119 thereof; (6) a light chain immunoglobulin comprising CDR-L1, CDR-L2 and CDR-L3 of the immunoglobulin comprising the amino acid sequence of SEQ ID NO: 126 or amino acids 21-131 thereof, and having at least 90% amino acid sequence identity to the amino acid sequence set forth in SEQ ID NO: 126 or amino acids 21-131 thereof, and/or a heavy chain immunoglobulin comprising CDR-H1, CDR-H2 and CDR-H3 of the immunoglobulin comprising the amino acid sequence of SEQ ID NO: 116 or amino acids 1-119 thereof, and having at least 90% amino acid sequence identity to the amino acid sequence set forth in SEQ ID NO: 116 or amino acids 1-119 thereof; (7) a light chain immunoglobulin comprising CDR-L1, CDR-L2 and CDR-L3 of the immunoglobulin comprising the amino acid sequence of SEQ ID NO: 126 or amino acids 21-131 thereof, and having at least 90% amino acid sequence identity to the amino acid sequence set forth in SEQ ID NO: 126 or amino acids 21-131 thereof, and/or a heavy chain immunoglobulin comprising CDR-H1, CDR-H2 and CDR-H3 of the immunoglobulin comprising the amino acid sequence of SEQ ID NO: 118 or amino acids 1-119 thereof, and having at least 90% amino acid sequence identity to the amino acid sequence set forth in SEQ ID NO: 118 or amino acids 1-119 thereof; (8) a light chain immunoglobulin comprising CDR-L1, CDR-L2 and CDR-L3 of the immunoglobulin comprising the amino acid sequence of SEQ ID NO: 126 or amino acids 21-131 thereof, and having at least 90% amino acid sequence identity to the amino acid sequence set forth in SEQ ID NO: 126 or amino acids 21-131 thereof, and/or a heavy chain immunoglobulin comprising CDR-H1, CDR-H2 and CDR-H3 of the immunoglobulin comprising the amino acid sequence of SEQ ID NO: 120 or amino acids 1-119 thereof, and having at least 90% amino acid sequence identity to the amino acid sequence set forth in SEQ ID NO: 120 or amino acids 1-119 thereof; and/or (9) a light chain immunoglobulin comprising CDR-L1, CDR-L2 and CDR-L3 of the immunoglobulin comprising the amino acid sequence of SEQ ID NO: 126 or amino acids 21-131 thereof, and having at least 90% amino acid sequence identity to the amino acid sequence set forth in SEQ ID NO: 126 or amino acids 21-131 thereof, and/or a heavy chain immunoglobulin comprising CDR-H1, CDR-H2 and CDR-H3 of the immunoglobulin comprising the amino acid sequence of SEQ ID NO: 122 or amino acids 1-119 thereof, and having at least 90% amino acid sequence identity to the amino acid sequence set forth in SEQ ID NO: 122 or amino acids 1-119 thereof. In an embodiment of the invention, the antibody or antigen-binding fragment comprises the various mature light and/or mature heavy chain immunoglobulin variable regions and having at least 90% overall amino acid sequence identity to the unprocessed immunoglobulin variable region (including the signal sequence), i.e., variability occurs outside the mature immunoglobulin chain sequences.

The present invention provides an antibody or antigen-binding fragment thereof that specifically binds LAG3 (e.g., human or cynomolgus monkey LAG3) that comprises a mature or unprocessed $V_L$ domain or light chain immunoglobulin of SEQ ID NO: 7, 17, 27, 37, 57, 59, 61, 63, 65, 101, 126, 130, 132, 136, 138, 208, 210, 224, 226, 228, 230, 232, 241, 257, 259, 261, 263, 351, 369, 371, 373, 375, 401, 403, 405, 426, 427, 451-453 or 459-461; and/or a mature or unprocessed $V_H$ domain or heavy chain immunoglobulin of SEQ ID NO: 2, 12, 22, 32, 45, 47, 49, 51, 53, 55, 67, 69, 71, 73, 75, 77, 79, 81, 83, 85, 87, 89, 91, 93, 95, 97, 99, 103, 106, 108, 110, 112, 114, 116, 118, 120, 122, 124, 128, 134, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 212, 214, 216, 218, 220, 222, 234, 235, 237, 239, 243, 245, 247, 249, 251, 253, 255, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 353, 355, 357, 359, 361, 363, 365, 367, 377, 379, 381, 383, 385, 387, 389, 391, 393, 395, 397, 399, 406-419, 434-442, 448, 449, 462, 463 or 464. In an embodiment of the invention, the antibody or antigen-binding fragment thereof comprises: (1) a light chain variable domain comprising: CDR-L1 that comprises the amino acid sequence: KASQSLDYEGDSDMN (SEQ ID NO: 38); CDR-L2 that comprises the amino acid sequence: GASNLES (SEQ ID NO: 39); and CDR-L3 that comprises the amino acid sequence: QQSTEDPRT (SEQ ID NO: 40); and/or a heavy chain variable domain comprising: CDR-H1 that comprises the amino acid sequence: DYNVD (SEQ ID NO: 33); CDR-H2 that comprises the amino acid sequence: DINPNNGGTIYAQKFQE (SEQ ID NO: 458); and CDR-H3 that comprises the amino acid sequence: NYRWFGAMDH (SEQ ID NO: 35); or (2) a light chain variable domain comprising: CDR-L1 that comprises the amino acid sequence: KASQSLDYEGDSDMN (SEQ ID NO: 38); CDR-L2 that comprises the amino acid sequence: GASNLES (SEQ ID NO: 39); and CDR-L3 that comprises the amino acid sequence: QQSTEDPRT (SEQ ID NO: 40); and/or a heavy chain variable domain comprising: CDR-H1 that comprises the amino acid sequence: DYNVD (SEQ ID NO: 33); CDR-H2 that comprises the amino acid sequence: DINPNSGGTIYAQKFQE (SEQ ID NO: 456); and CDR-H3 that comprises the amino acid sequence: NYRWFGAMDH (SEQ ID NO: 35); or (3) a light chain variable domain comprising: CDR-L1 that comprises the amino acid sequence: KASQSLDYEGDSDMN (SEQ ID NO: 38); CDR-L2 that comprises the amino acid sequence: GASNLES (SEQ ID NO: 39); and CDR-L3 that comprises the amino acid sequence: QQSTEDPRT (SEQ ID NO: 40); and/or a heavy chain variable domain comprising: CDR-H1 that comprises the amino acid sequence: DYNVD (SEQ ID NO: 33); CDR-H2 that comprises the amino acid sequence: DINPNDGGTIYAQKFQE (SEQ ID NO: 457); and CDR-H3 that comprises the amino acid sequence: NYRWFGAMDH (SEQ ID NO: 35); or (4) a light chain variable domain comprising: CDR-L1 that comprises the amino acid sequence: KASQSLDYEGDSDMN (SEQ ID NO: 38); CDR-L2 that comprises the amino acid sequence: GASNLES (SEQ ID NO: 39); and CDR-L3 that comprises the amino acid sequence: QQSTEDPRT (SEQ ID NO: 40); and/or a heavy chain variable domain comprising: CDR-H1 that comprises the amino acid sequence: DYNVD (SEQ ID NO: 33); CDR-H2 that comprises the amino acid sequence: DINPNQGGTIYAQKFQE (SEQ ID NO: 455); and CDR-H3 that comprises the amino acid sequence: NYRWFGAMDH (SEQ ID NO: 35); or (5) a light chain variable domain comprising: CDR-L1 that comprises the amino acid sequence: KASQSLDYEGDSDMN (SEQ ID NO: 38); CDR-L2 that comprises the amino acid sequence: GASNLES (SEQ ID NO: 39); and CDR-L3 that comprises the amino acid sequence: QQSTEDPRT (SEQ ID NO: 40); and/or a heavy chain variable domain comprising: CDR-H1 that comprises the amino acid sequence: DYNVD (SEQ ID NO: 33); CDR-H2 that comprises the amino acid sequence: DINPNGGGTIYAQKFQE (SEQ ID NO: 454); and CDR-H3 that comprises the amino acid sequence: NYRWFGAMDH (SEQ ID NO: 35). In an embodiment of the invention, the antibody or fragment is glycosylated with engineered yeast N-linked glycans or CHO N-linked glycans. Optionally, any of the anti-LAG3 antibodies or antigen-binding fragments thereof of the invention are characterized by one or more of the following properties: Inhibits LAG3 binding to MHC class II molecules; Competes with MHC class II molecules for LAG3 binding; Binds the extraloop of LAG3; Binds LAG3 with a $K_D$ of about $10^{-9}$M to about $2\times10^{-12}$M; Binds to native LAG3 on the surface of activated CD4+ and/or CD8+ T-cells; Binds to human and/or cynomolgus monkey LAG3; Inhibits LAG3 homodimerization; Stimulates antigen-specific T-cell production of IL-2; labels tonsil tissue; does not label brain, heart, kidney, liver, lung, pancreas, and/or pituitary tissue; binds to human LAG3 by contacting residues QEGAPAQL (amino acids 35-42 of SEQ ID NO: 443) and RPARRADAGEYRAAVH (amino acids 137-152 of SEQ ID NO: 443) and, optionally, residues DERGRQRGDFSLW (amino acids 123-135 of SEQ ID NO: 443) of LAG3; or residues SPTIPLQDL (amino acids 45-53 of SEQ ID NO: 443) and, optionally DERGRQRGDFSL (amino acids 123-134 of SEQ ID NO: 443) of LAG3; or residues HPLAPGPHPAAPSSWG-PRPRRYTVL (amino acids 78-102 of SEQ ID NO: 443) of LAG3; and/or by protecting hydrogens on the amide backbone of such residues from exchange with a deuterium. The present invention also provides any such antibody or fragment in a pharmaceutically acceptable carrier or diluent. In an embodiment of the invention, the anti-LAG3 antibody or fragment is immobilized to a solid substrate. In an embodiment of the invention the anti-LAG3 antibody or antigen-binding fragment thereof is Ab1, Ab2, Ab3, Ab4, Ab5, Ab6, Ab7, Ab8 or Ab9 (as set forth herein).

The present invention also provides a complex comprising an anti-LAG3 antibody or fragment discussed herein (e.g., 4A10, 19E8, 11C9 and/or 22D2; e.g., Ab1, Ab2, Ab3, Ab4, Ab5, Ab6, Ab7, Ab8 and/or Ab9) complexed with LAG3 (e.g., human or cynomolgus monkey) or a fragment thereof or with a secondary antibody (e.g., detectably labeled secondary antibody) that binds specifically to the anti-LAG3 antibody or fragment. In an embodiment of the invention, the antibody or fragment is in vitro (e.g., is immobilized to a solid substrate) or is in the body of a subject. In an embodiment of the invention, the LAG3 is in vitro (e.g., is immobilized to a solid substrate) or is on the surface of a cell or is in the body of a subject.

The present invention further provides a composition comprising a plurality of anti-LAG3 antibodies or antigen-binding fragments of the present invention which are isolated, monoclonal antibodies or antigen-binding fragments thereof, e.g., which are humanized, e.g., humanized antagonistic antibodies and antigen-binding fragments thereof.

The present invention also provides a composition comprising anti-LAG3 antibodies or antigen-binding fragments thereof as discussed herein in association with a further therapeutic agent (e.g., a monoclonal antibody or antigen-binding fragment thereof or an organic small molecule) such as an inhibitor of an immunomodulatory receptor, an anti-emetic, an MTOR (mammalian target of rapamycin) inhibitor, a cytotoxic agent, a platinum agent, an EGFR (epidermal growth factor receptor) inhibitor, a VEGF (vascular epidermal growth factor) inhibitor, a microtubule stabilizer, a taxane, a CD20 inhibitor, a CD52 inhibitor, a CD30 inhibitor, a RANK (Receptor activator of nuclear factor kappa-B) inhibitor, a RANKL (Receptor activator of nuclear factor kappa-B ligand) inhibitor, an ERK inhibitor, a MAP Kinase inhibitor, an AKT inhibitor, a MEK inhibitor, a PI3K inhibitor, a HER1 inhibitor, a HER2 inhibitor, a HER3 inhibitor, a HER4 inhibitor, a Bcl2 inhibitor, a CD22 inhibitor, a CD79b inhibitor, an ErbB2 inhibitor, and/or a farnesyl protein transferase inhibitor. In an embodiment of the invention, the further therapeutic agent is an anti-PD1 antibody or an antigen-binding fragment thereof, pembrolizumab, nivolumab, CT-011, anti-CTLA4 antibody or an antigen-binding fragment thereof, anti-TIM3 antibody or an antigen-binding fragment thereof, anti-CS1 antibody or an antigen-binding fragment thereof, elotuzumab, anti-KIR2DL1/2/3 antibody or an antigen-binding fragment thereof, lirilumab, anti-CD137 antibody or an antigen-binding fragment thereof, urelumab, anti-GITR antibody or an antigen-binding fragment thereof, TRX518, anti-PD-L1 antibody or an antigen-binding fragment thereof, BMS-936559, MSB0010718C, MPDL3280A, anti-PD-L2 antibody or an antigen-binding fragment thereof, anti-ILT1 antibody or an antigen-binding fragment thereof, anti-ILT2 antibody or an antigen-binding fragment thereof, anti-ILT3 antibody or an antigen-binding fragment thereof, anti-ILT4 antibody or an antigen-binding fragment thereof, anti-ILT5 antibody or an antigen-binding fragment thereof, anti-ILT6 antibody or an antigen-binding fragment thereof, anti-ILT7 antibody or an antigen-binding fragment thereof, anti-ILT8 antibody or an antigen-binding fragment thereof, anti-CD40 antibody or an antigen-binding fragment thereof, anti-OX40 antibody or an antigen-binding fragment thereof, anti-CD137 antibody or an antigen-binding fragment thereof, anti-KIR2DL1 antibody or an antigen-binding fragment thereof, anti-KIR2DL2/3 antibody or an antigen-binding fragment thereof, anti-KIR2DL4 antibody or an antigen-binding fragment thereof, anti-KIR2DL5A antibody or an antigen-binding fragment thereof, anti-KIR2DL5B antibody or an antigen-binding fragment thereof, anti-KIR3DL1 antibody or an antigen-binding fragment thereof, anti-KIR3DL2 antibody or an antigen-binding fragment thereof, anti-KIR3DL3 antibody or an antigen-binding fragment thereof, anti-NKG2A antibody or an antigen-binding fragment thereof, anti-NKG2C antibody or an antigen-binding fragment thereof, and/or an anti-NKG2E antibody or an antigen-binding fragment thereof, or any small organic molecule inhibitor of such targets; IL-10, anti-IL10, anti-TSLP and/or PEGylated IL-10. In an embodiment of the invention, the further therapeutic agent is 13-cis-retinoic acid, 3-[5-(methylsulfonylpiperadinemethyl)-indolyl]-quinolone, 4-hydroxytamoxifen, 5-deoxyuridine, 5'-deoxy-5-fluorouridine, 5-fluorouracil, 6-mecaptopurine, 7-hydroxystaurosporine, A-443654, abirateroneacetate, abraxane, ABT-578, acolbifene, ADS-100380, aflibercept, ALT-110, altretamine, amifostine, aminoglutethimide, amrubicin, amsacrine, anagrelide, anastrozole, angiostatin, AP-23573, ARQ-197, arzoxifene, AS-252424, AS-605240, asparaginase, AT-9263, ATI3387, atrasentan, axitinib, AZD1152, *Bacillus* Calmette-Guerin (BCG) vaccine, batabulin, BC-210, BGJ398, besodutox, bevacizumab, bicalutamide, Bio111, BIO140, BKM120, bleomycin, BMS-214662, BMS-247550, BMS-275291, BMS-310705, bortezimib, buserelin, busulfan, calcitriol, camptothecin, canertinib, capecitabine, carboplatin, carmustine, CC8490, cediranib, CG-1521, CG-781, chlamydocin, chlorambucil, chlorotoxin, cilengitide, cimitidine, cisplatin, cladribine, clodronate, cobimetnib, COL-3, CP-724714, cyclophosphamide, cyproterone, cyproteroneacetate, cytarabine, cytosinearabinoside, dabrafenib, dacarbazine, dacinostat, dactinomycin, dalotuzumab, danusertib, dasatanib, daunorubicin, decatanib, deguelin, denileukin, deoxycoformycin, depsipeptide, diarylpropionitrile, diethylstilbestrol, diftitox, DNE03, docetaxel, dovitinib, doxorubicin, droloxifene, edotecarin, yttrium-90 labeled-edotreotide, edotreotide, EKB-569, EMD121974, encorafenib, endostatin, enzalutamide, enzastaurin, epirubicin, epithilone B, ERA-923, erbitux, erlotinib, estradiol, estramustine, etoposide, everolimus, exemestane, ficlatuzumab, finasteride, flavopiridol, floxuridine, fludarabine, fludrocortisone, fluoxymesterone, flutamide, FOLFOX regimen, fulvestrant, galeterone, ganetespib, gefitinib, gemcitabine, gimatecan, goserelin, goserelin acetate, gossypol, GSK461364, GSK690693, HMR-3339, hydroxyprogesteronecaproate, hydroxyurea, IC87114, idarubicin, idoxyfene, ifosfamide, IM862, imatinib, IMC-1C11, INCB24360, INC280, INO1001, interferon, interleukin-12, ipilimumab, irinotecan, JNJ-16241199, ketoconazole, KRX-0402, lapatinib, lasofoxifene, LEE011, letrozole, leucovorin, leuprolide, leuprolide acetate, levamisole, liposome entrapped paclitaxel, lomustine, lonafarnib, lucanthone, LY292223, LY292696, LY293646, LY293684, LY294002, LY3009120, LY317615, marimastat, mechlorethamine, medroxyprogesteroneacetate, megestrolacetate, MEK162, melphalan, mercaptopurine, mesna, methotrexate, mithramycin, mitomycin, mitotane, mitoxantrone, tozasertib, MLN8054, natitoclax, neovastat, neratinib, neuradiab, nilotinib, nilutimide, nolatrexed, NVP-BEZ235, oblimersen, octreotide, ofatumumab, oregovomab, ornatuzumab, orteronel, oxaliplatin, paclitaxel, palbociclib, pamidronate, panitumumab, pazopanib, PD0325901, PD184352, PEG-interferon, pemetrexed, pentostatin, perifosine, phenylalaninemustard, PI-103, pictilisib, PIK-75, pipendoxifene, PKI-166, plicamycin, PLX8394, porfimer, prednisone, procarbazine, progestins, PX-866, R-763, raloxifene, raltitrexed, razoxin, ridaforolimus, rituximab, romidepsin, RTA744, rubitecan, scriptaid, Sdx102, seliciclib, selumetinib, semaxanib, SF1126, sirolimus, SN36093, sorafenib, spironolactone, squalamine, SR13668, streptozocin, SU6668, suberoylanalide hydroxamic acid, sunitinib, synthetic estrogen, talampanel, talimogene laherparepvec, tamoxifen, temozolomide, temsirolimus, teniposide, tesmilifene, testosterone, tetrandrine, TGX-221, thalidomide, 6-thioguanine, thiotepa, ticilimumab, tipifarnib, tivozanib, TKI-258, TLK286, topotecan, toremifene citrate, trabectedin, trametinib, trastuzumab, tretinoin, trichostatin A, triciribinephosphate monohydrate, triptorelin pamoate, TSE-424, uracil mustard, valproic acid, valrubicin, vandetanib, vatalanib, VEGF trap, vemurafenib, vinblastine, vincristine, vindesine, vinorelbine, vitaxin, vitespan, vorinostat, VX-745, wortmannin, Xr311, zanolimumab, ZK186619, ZK-304709, ZM336372, ZSTK474, casopitant, netupitant, palonosetron, aprepitant, diphenhydramine, hydroxyzine, metoclopramide, lorazepam, alprazolam, haloperidol, droperidol, dronabinol, dexamethasone, methylprednisolone, prochlorperazine, granisetron, ondansetron, dolasetron, tropisetron, GCSF, PEG-GCSF, erythropoietin, epoetin alfa and darbepoetin alfa. In an embodiment of the invention, the anti-LAG3 antibody or antigen-binding fragment thereof is in association with pembrolizumab. In an embodiment of the invention, the anti-LAG3 antibody or antigen-binding fragment thereof is in association with novolumab. In an embodiment of the invention, the anti-LAG3 antibody or antigen-binding fragment thereof is in association with CT-011. In an embodiment of the invention, the anti-LAG3 antibody or antigen-binding fragment thereof is in association with BMS-936559.

The present invention also provides a polypeptide comprising an amino acid sequence selected from the group consisting of 2, 3, 4, 5, 7, 8, 9, 10, 12, 13, 14, 15, 17, 18, 19, 20, 22, 23, 24, 25, 27, 28, 29, 30, 32, 33, 34, 35, 37, 38, 39, 40, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 406, 407, 408, 409, 410, 411, 412, 413, 414, 415, 416, 417, 418, 419, 426, 427, 434, 435, 436, 437, 438, 439, 440, 441, 442, 446, 448, 449, 451, 452, 453, 454, 455, 456, 457, 458, 459, 460, 461, 462, 463 and 464 for example, SEQ ID NOs: 2, 7, 12, 17, 22, 27, 32 and 37; or a mature fragment thereof. The present invention also provides a polynucleotide encoding any of such polypeptides, e.g., comprising a nucleotide sequence selected from the group consisting of SEQ ID NOs: 1, 6, 11, 16, 21, 26, 31, 36, 46, 48, 50, 52, 54, 56, 56, 58, 60, 62, 64, 66, 68, 70, 72, 74, 76, 78, 80, 82, 84, 86, 88, 90, 92, 94, 96, 98, 100, 102, 104, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402 and 404; or a mature fragment thereof. Also included in the present invention is a vector (e.g., a plasmid) comprising the polynucleotide. A host cell (e.g., mammalian, bacterial, Chinese hamster ovary (CHO), lower eukaryotic, fungal, yeast, *Pichia, Pichia pastoris*) is also part of the present invention wherein the host cell comprises an antibody, fragment, polypeptide, polynucleotide and/or vector set forth herein.

The present invention also provides vaccines comprising an antibody or fragment set forth herein, an antigen (e.g., viral peptide antigen, virus-like particle, tumor peptide antigen) and a pharmaceutically acceptable carrier.

The prevent invention also provides a vessel (e.g., plastic or glass vial) or an injection device (e.g., a syringe such as a pre-filled syringe or an autoinjector) comprising any antibody, fragment, polypeptide, polynucleotide, vector, composition or vaccine discussed herein.

The present invention also provides a method of treating a cancer (e.g., osteosarcoma, rhabdomyosarcoma, neuroblastoma, kidney cancer, leukemia, renal transitional cell cancer, bladder cancer, Wilm's cancer, ovarian cancer, pancreatic cancer, breast cancer, prostate cancer, bone cancer, lung cancer, gastric cancer, colorectal cancer, cervical cancer, synovial sarcoma, head and neck cancer, squamous cell carcinoma, multiple myeloma, renal cell cancer, retinoblastoma, hepatoblastoma, hepatocellular carcinoma, melanoma, rhabdoid tumor of the kidney, Ewing's sarcoma, chondrosarcoma, brain cancer, glioblastoma, meningioma, pituitary adenoma, vestibular schwannoma, a primitive neuroectodermal tumor, medulloblastoma, astrocytoma, anaplastic astrocytoma, oligodendroglioma, ependymoma, choroid plexus papilloma, polycythemia vera, thrombocythemia, idiopathic myelfibrosis, soft tissue sarcoma, thyroid cancer, endometrial cancer, carcinoid cancer or liver cancer, breast cancer or gastric cancer) in a subject, comprising administering to the subject a effective amount of an anti-LAG3 antibody or antigen-binding fragment or vaccine discussed herein optionally, in association with a further therapeutic agent or a therapeutic procedure (e.g., surgical tumorectomy or anti-cancer radiation therapy).

The present invention also provides a method of administering an anti-LAG3 antibody, fragment, composition, polypeptide, vaccine or polynucleotide discussed herein, or a pharmaceutical composition thereof, to a subject comprising injecting the antibody, fragment, polypeptide, vaccine or polynucleotide into the body of the subject using an injection device; and, optionally, also administering a further therapeutic agent to the subject.

The present invention also provides a method of producing an anti-LAG3 antibody or antigen-binding fragment thereof or polypeptide discussed herein comprising: a. culturing a host cell comprising a polynucleotide encoding the polypeptide or an immunoglobulin chain of the antibody or fragment in culture medium under conditions favorable to expression of the polynucleotide; and b. optionally, recovering the antibody, fragment or polypeptide from the host cell and/or culture medium. In an embodiment of the invention, the method comprises the step of introducing the polynucleotide into the host cell, e.g., by transformation or transfection.

The present invention also provides a method for detecting the presence of a LAG3 peptide or a fragment thereof in a sample comprising contacting the sample with an anti-LAG3 antibody or fragment discussed herein and detecting the presence of a complex between the antibody or fragment and the peptide; wherein detection of the complex indicates the presence of the LAG3 peptide.

DETAILED DESCRIPTION

Figure 1:
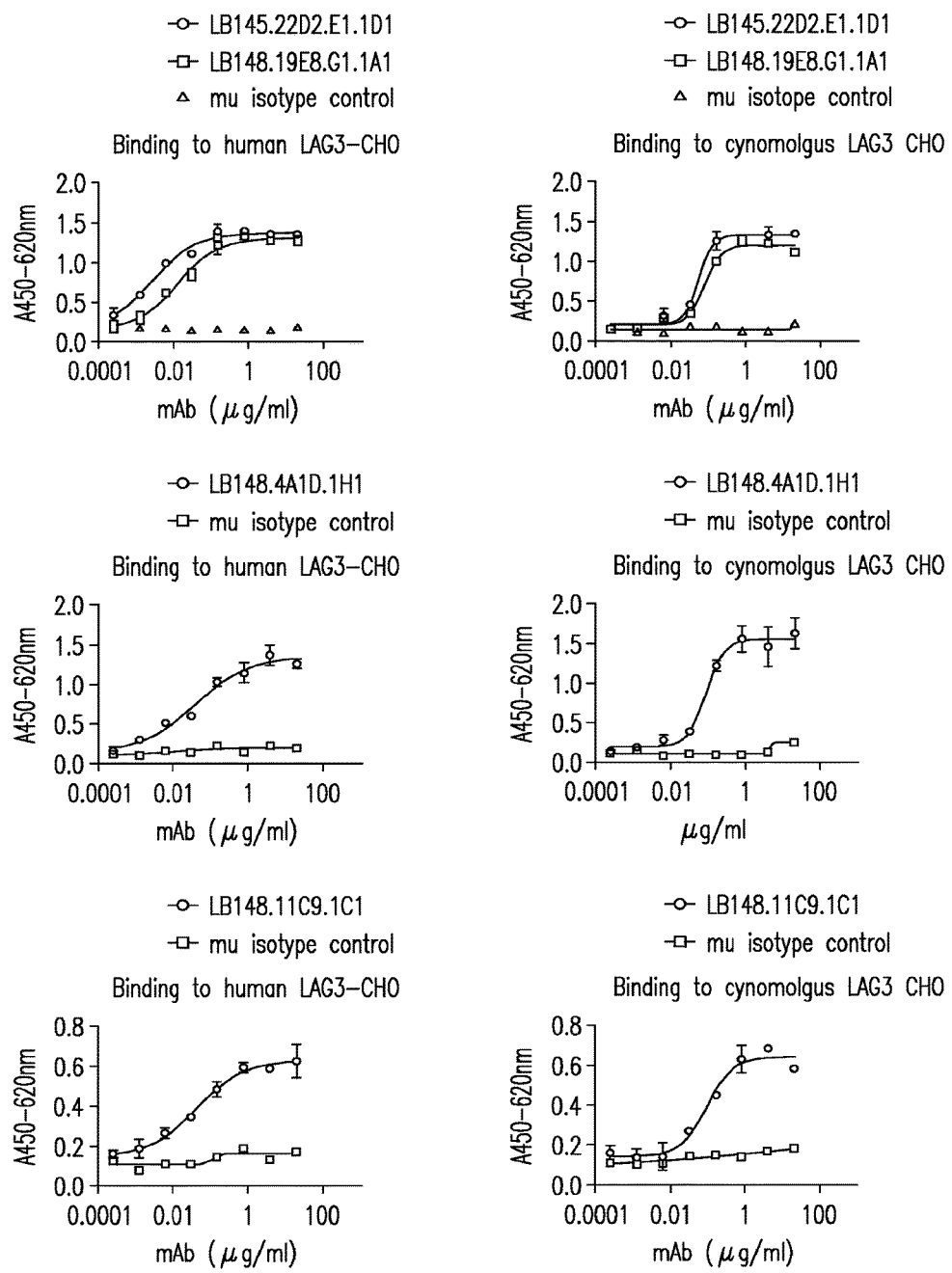
FIG. 1. Binding of anti-human LAG3 clones to human and cynomolgus monkey LAG3 expressing CHO-K1 cells.

The present invention provides antibodies and antigen-binding fragments thereof that have exceptionally high affinity for human LAG3 and cynomolgous monkey LAG3, e.g., Ab1, Ab2, Ab3, Ab4, Ab5, Ab6, Ab7, Ab8 or Ab9 as well as uses thereof and methods of making the same as is discussed herein. For example, affinity ($K_D$) for human LAG3 by KinExA assay was measured to be as high as 2 pM and affinity for cynomolgous LAG3 is in the low double digit pM range. A particularly low isoelectric point (e.g., about 6.3) makes some of these antibodies unique. Moreover, though some antibodies bind LAG3 primarily outside the extraloop region, they exhibit the ability to block LAG3/MCH class II binding. Furthermore, the anti-LAG3 antibodies of the present invention have a high degree of specificity for binding to LAG3 over other related proteins. Such antibodies and fragments set forth herein may be useful, for example, for treatment of various cancers and infectious diseases.

ABBREVIATIONS

Throughout the detailed description and examples of the invention the following abbreviations will be used:
ADCC Antibody-dependent cellular cytotoxicity
CDC Complement-dependent cytotoxicity
CDR Complementarity determining region in the immunoglobulin variable regions, defined using the Kabat numbering system
CHO Chinese hamster ovary
EC50 concentration resulting in 50% efficacy or binding
ELISA Enzyme-linked immunosorbant assay
FR Antibody framework region: the immunoglobulin variable regions excluding the CDR regions.
HRP Horseradish peroxidase
IC50 concentration resulting in 50% inhibition
IgG Immunoglobulin G
Kabat An immunoglobulin alignment and numbering system pioneered by Elvin A. Kabat ((1991) Sequences of Proteins of Immunological Interest, 5th Ed. Public Health Service, National Institutes of Health, Bethesda, Md.)
mAb or Mab or MAb Monoclonal antibody
PCR Polymerase chain reaction
V region The segment of IgG chains which is variable in sequence between different antibodies. It extends to Kabat residue 109 in the light chain and 113 in the heavy chain.
VH Immunoglobulin heavy chain variable region
VK Immunoglobulin kappa light chain variable region

Definitions

So that the invention may be more readily understood, certain technical and scientific terms are specifically defined below. Unless specifically defined elsewhere in this document, all other technical and scientific terms used herein have the meaning commonly understood by one of ordinary skill in the art to which this invention belongs.

As used herein, including the appended claims, the singular forms of words such as "a," "an," and "the," include their corresponding plural references unless the context clearly dictates otherwise.

LAG3

The term "LAG3", with respect to the polypeptide to which antibodies and antigen-binding fragments of the present invention bind, refers to human and cynomolgous monkey, e.g., *Macaca fascicularis* or *Macaca mulatta* LAG3 as well as fragments thereof such as the mature fragment thereof lacking the signal peptide.

In an embodiment of the invention, the amino acid sequence of human LAG3 (Lymphocyte Activation Gene-3) comprises the amino acid sequence:

```
                                          (SEQ ID NO: 443)
MWEAQFLGLL FLQPLWVAPV KPLQPGAEVP VVWAQEGAPA

QLPCSPTIPL QDLSLLRRAG VTWQHQPDSG PPAAAPGHPL

APGPHPAAPS SWGPRPRRYT VLSVGPGGLR SGRLPLQPRV

QLDERGRQRG DFSLWLRPAR RADAGEYRAA VHLRDRALSC

RLRLRLGQAS MTASPPGSLR ASDWVILNCS FSRPDRPASV

HWFRNRGQGR VPVRESPHHH LAESFLFLPQ VSPMDSGPWG

CILTYRDGFN VSIMYNLTVL GLEPPTPLTV YAGAGSRVGL

PCRLPAGVGT RSFLTAKWTP PGGGPDLLVT GDNGDFTLRL

EDVSQAQAGT YTCHIHLQEQ QLNATVTLAI ITVTPKSFGS

PGSLOKLLCE VTPVSGQERF VWSSLDTPSQ RSFSGPWLEA
```

-continued
```
QEAQLLSQPW QCQLYQGERL LGAAVYFTEL SSPGAQRSGR

APGALPAGHL LLFLILGVLS LLLLVTGAFG FHLWRRQWRP

RRFSALEQGI HPPQAQSKIE ELEQEPEPEP EPEPEPEPEP

EPEQL; see also Uniprot accession no. P18627.
```

In an embodiment of the invention, the amino acid sequence of mouse LAG3 comprises the amino acid sequence:

```
                                    (SEQ ID NO: 444)
MREDLLLGFL LLGLLWEAPV VSSGPGKELP VVWAQEGAPV

HLPCSLKSPN LDPNFLRRGG VIWQHQPDSG QPTPIPALDL

HQGMPSPRQP APGRYTVLSV APGGLRSGRQ PLHPHVQLEE

RGLQRGDFSL WLRPALRTDA GEYHATVRLP NRALSCSLRL

RVGQASMIAS PSGVLKLSDW VLLNCSFSRP DRPVSVHWFQ

GQNRVPVYNS PRHFLAETFL LLPQVSPLDS GTWGCVLTYR

DGFNVSITYN LKVLGLEPVA PLTVYAAEGS RVELPCHLPP

GVGTPSLLIA KWTPPGGGPE LPVAGKSGNF TLHLEAVGLA

QAGTYTCSIH LQGQQLNATV TLAVITVTPK SFGLPGSROK

LLCEVTPASG KERFVWRPLN NLSRSCPGPV LEIQEARLLA

ERWQCQLYEG QRLLGATVYA AESSSGAHSA RRISGDLKGG

HLVLVLILGA LSLFLLVAGA FGFHWWRKQL LLRRFSALEH

GIQPFPAQRK IEELERELET EMGQEPEPEP EPQLEPEPRQ
L; See also Uniprot accession no. Q61790
```

In an embodiment of the invention, the amino acid sequence of cynomolgus monkey LAG3 comprises the amino acid sequence:

```
                                    (SEQ ID NO: 445)
MWEAQFLGLL FLQPLWVAPV KPPQPGAEIS VVWAQEGAPA

QLPCSPTIPL QDLSLLRRAG VTWQHQPDSG PPAXAPGHPP

VPGHRPAAPY SWGPRPRRYT VLSVGPGGLR SGRLPLQPRV

QLDERGRQRG DFSLWLRPAR RADAGEYRAT VHLRDRALSC

RLRLRVGQAS MTASPPGSLR TSDWVILNCS FSRPDRPASV

HWFRSRGQGR VPVQGSPHHH LAESFLFLPH VGPMDSGLWG

CILTYRDGFN VSIMYNLTVL GLEPATPLTV YAGAGSRVEL

PCRLPPAVGT QSFLTAKWAP PGGGPDLLVA GDNGDFTLRL

EDVSQAQAGT YICHIRLQGQ QLNATVTLAI ITVTPKSFGS

PGSLOKLLCE VTPASGQEHF VWSPLNTPSQ RSFSGPWLEA

QEAQLLSQPW QCQLHQGERL LGAAVYFTEL SSPGAQRSGR

APGALRAGHL PLFLILGVLF LLLLVTGAFG FHLWRRQWRP

RRFSALEQGI HPPQAQSKIE ELEQEPELEP EPELERELGP

EPEPGPEPEP EQL; See also NCBI reference
number XP_005570011.1
```

The mature sequence of human, mouse and cynomolgus monkey LAG3, i.e. the sequence after removal of the signal peptide, comprises amino acids 1-28 of SEQ ID NO: 443, 444 or 445.

LAG3 sequences may differ, for example, by having, for example, conserved mutations or mutations in non-conserved regions, e.g., wherein the LAG3 has substantially the same biological function as the LAG3 of SEQ ID NOs: 443 or 445. For example, biological functions of LAG3 are to bind to major histocompatibility complex (MHC) class II molecules and to form homodimers.

A particular LAG3 sequence will generally be at least 90% identical in amino acid sequence to LAG3 of SEQ ID NOs: 443 or 445 or other isoforms. In certain cases, a LAG3 may be at least 95%, or even at least 96%, 97%, 98% or 99% identical to a LAG3 of SEQ ID NOs: 443 or 445, or other isoforms or variants. In certain embodiments, a LAG3 sequence will display no more than 10 amino acid differences from the LAG3 of any of SEQ ID NOs: 443 or 445, or other isoforms or variants. In certain embodiments, the LAG3 may display no more than 5, or even no more than 4, 3, 2, or 1 amino acid difference from a LAG3 of SEQ ID NOs: 443 or 445, or other isoforms or variants. Percent identity can be determined as described herein.

Anti-LAG3 Antibodies and Antigen-Binding Fragments Thereof

The present invention provides antibodies or antigen-binding fragments thereof that specifically bind LAG3 (e.g., human and/or cynomolgous monkey, e.g., *Macaca fascicularis* or *Macaca mulatta* LAG3), for example, 4A10, 19E8, 11C9, 22D2, e.g., Ab1, Ab2, Ab3, Ab4, Ab5, Ab6, Ab7, Ab8 or Ab9, and uses of such antibodies or fragments. In an embodiment of the invention, the antibody or fragment is an antibody.

As used herein, an anti-LAG3 antibody or antigen-binding fragment thereof refers to an antibody or antigen-binding fragment thereof that specifically binds to human or cynomolgous monkey LAG3. An antibody binds specifically to a polypeptide comprising a given sequence (in this case an epitope of human or cynomolgous monkey LAG3) if it binds to polypeptides comprising the LAG3 sequence with a $K_D$ of about 1 nM or a higher affinity (e.g., 1 nM-2 pM, 1 nM, 100 pM, 10 pM or 2 pM), but does not bind to proteins lacking the sequence. For example, an antibody or antigen-binding fragment that specifically binds to a polypeptide comprising human or cynomolgous monkey LAG3 may bind to a FLAG®-tagged form of human or cynomolgous monkey LAG3 but will not bind to other FLAG®-tagged proteins that lack LAG3 epitopes.

The present invention includes anti-LAG3 antibodies and methods of use thereof. As used herein, the term "antibody" refers to any form of antibody that exhibits the desired biological activity. Thus, it is used in the broadest sense and specifically covers, but is not limited to, monoclonal antibodies (including full length monoclonal antibodies), polyclonal antibodies, multispecific antibodies (e.g., bispecific antibodies), humanized antibodies, fully human antibodies, chimeric antibodies and camelized single domain antibodies.

The present invention includes parental anti-LAG3 antibodies and antigen-binding fragments thereof and methods of use thereof. "Parental antibodies and antigen-binding fragments thereof" are antibodies and fragments which may be modified for an intended use, such as humanization of an antibody for use as a human therapeutic antibody or fragment.

The present invention includes anti-LAG3 antigen-binding fragments and methods of use thereof. As used herein, unless otherwise indicated, "antibody fragment" or "antigen-binding fragment" refers to antigen-binding fragments of antibodies, i.e. antibody fragments that retain the ability to bind specifically to the antigen bound by the full-length antibody, e.g. fragments that retain one or more CDR regions. Examples of antigen-binding fragments include, but are not limited to, Fab, Fab', F(ab')$_2$, and Fv fragments; diabodies; single-chain antibody molecules, e.g., sc-Fv; nanobodies and multispecific antibodies formed from antibody fragments.

The present invention includes anti-LAG3 Fab fragments and methods of use thereof. A "Fab fragment" is comprised of one light chain and the $C_H1$ and variable regions of one heavy chain. The heavy chain of a Fab molecule cannot form a disulfide bond with another heavy chain molecule. An "Fab fragment" can be the product of papain cleavage of an antibody.

The present invention includes anti-LAG3 antibodies and antigen-binding fragments thereof which comprise an Fc region and methods of use thereof. An "Fc" region contains two heavy chain fragments comprising the $C_H1$ and $C_H2$ domains of an antibody. The two heavy chain fragments are held together by two or more disulfide bonds and by hydrophobic interactions of the $C_H3$ domains.

The present invention includes anti-LAG3 Fab' fragments and methods of use thereof. A "Fab' fragment" contains one light chain and a portion or fragment of one heavy chain that contains the $V_H$ domain and the $C_H1$ domain and also the region between the $C_H1$ and $C_H2$ domains, such that an interchain disulfide bond can be formed between the two heavy chains of two Fab' fragments to form a F(ab')$_2$ molecule.

The present invention includes anti-LAG3 F(ab')$_2$ fragments and methods of use thereof. A "F(ab')$_2$ fragment" contains two light chains and two heavy chains containing a portion of the constant region between the $C_{H1}$ and $C_{H2}$ domains, such that an interchain disulfide bond is formed between the two heavy chains. A F(ab')$_2$ fragment thus is composed of two Fab' fragments that are held together by a disulfide bond between the two heavy chains. An "F(ab')$_2$ fragment" can be the product of pepsin cleavage of an antibody.

The present invention includes anti-LAG3 Fv fragments and methods of use thereof. The "Fv region" comprises the variable regions from both the heavy and light chains, but lacks the constant regions.

The present invention includes anti-LAG3 scFv fragments and methods of use thereof. The term "single-chain Fv" or "scFv" antibody refers to antibody fragments comprising the $V_H$ and $V_L$ domains of an antibody, wherein these domains are present in a single polypeptide chain. Generally, the Fv polypeptide further comprises a polypeptide linker between the $V_H$ and $V_L$ domains which enables the scFv to form the desired structure for antigen-binding. For a review of scFv, see Pluckthun (1994) THE PHARMACOLOGY OF MONOCLONAL ANTIBODIES, vol. 113, Rosenburg and Moore eds. Springer-Verlag, New York, pp. 269-315. See also, International Patent Application Publication No. WO88/01649 and U.S. Pat. Nos. 4,946,778 and 5,260,203.

The present invention includes anti-LAG3 domain antibodies and methods of use thereof. A "domain antibody" is an immunologically functional immunoglobulin fragment containing only the variable region of a heavy chain or the variable region of a light chain. In some instances, two or more $V_H$ regions are covalently joined with a peptide linker to create a bivalent domain antibody. The two $V_H$ regions of a bivalent domain antibody may target the same or different antigens.

The present invention includes anti-LAG3 bivalent antibodies and methods of use thereof. A "bivalent antibody" comprises two antigen-binding sites. In some instances, the two binding sites have the same antigen specificities. However, bivalent antibodies may be bispecific (see below).

The present invention includes anti-LAG3 camelized single domain antibodies and methods of use thereof. In certain embodiments, antibodies herein also include camelized single domain antibodies. See, e.g., Muyldermans et al. (2001) Trends Biochem. Sci. 26:230; Reichmann et al. (1999) J. Immunol. Methods 231:25; WO 94/04678; WO 94/25591; U.S. Pat. No. 6,005,079). In one embodiment, the present invention provides single domain antibodies comprising two $V_H$ domains with modifications such that single domain antibodies are formed.

The present invention includes anti-LAG3 diabodies and methods of use thereof. As used herein, the term "diabodies" refers to small antibody fragments with two antigen-binding sites, which fragments comprise a heavy chain variable domain ($V_H$) connected to a light chain variable domain ($V_L$) in the same polypeptide chain ($V_H$-$V_L$ or $V_L$-$V_H$). By using a linker that is too short to allow pairing between the two domains on the same chain, the domains are forced to pair with the complementary domains of another chain and create two antigen-binding sites. Diabodies are described more fully in, e.g., EP 404,097; WO 93/11161; and Holliger et al. (1993) Proc. Natl. Acad. Sci. USA 90: 6444-6448. For a review of engineered antibody variants generally see Holliger and Hudson (2005) Nat. Biotechnol. 23:1126-1136.

Typically, an antibody or antigen-binding fragment of the invention which is modified in some way retains at least 10% of its LAG3 (e.g., human and/or cynomolgous monkey, e.g., Macaca fascicularis or Macaca mulatta LAG3) binding activity (when compared to the parental antibody) when that activity is expressed on a molar basis. Preferably, an antibody or antigen-binding fragment of the invention retains at least 20%, 50%, 70%, 80%, 90%, 95% or 100% or more of the LAG3 (e.g., human and/or cynomolgous monkey, e.g., Macaca fascicularis or Macaca mulatta LAG3) binding affinity as the parental antibody. It is also intended that an antibody or antigen-binding fragment of the invention can include conservative or non-conservative amino acid substitutions (referred to as "conservative variants" or "function conserved variants" of the antibody) that do not substantially alter its biologic activity.

The present invention includes isolated anti-LAG3 antibodies and antigen-binding fragments thereof (e.g., 4A10, 19E8, 11C9 and/or 22D2; e.g., Ab1, Ab2, Ab3, Ab4, Ab5, Ab6, Ab7, Ab8 and/or Ab9) and methods of use thereof as well as isolated polypeptide immunoglobulin chains thereof and isolated polynucleotides encoding such polypeptides and isolated vectors including such polynucleotides. "Isolated" antibodies or antigen-binding fragments thereof, polypepotides, polynucleotides and vectors, are at least partially free of other biological molecules from the cells or cell culture from which they are produced. Such biological molecules include nucleic acids, proteins, lipids, carbohydrates, or other material such as cellular debris and growth medium. An isolated antibody or antigen-binding fragment may further be at least partially free of expression system components such as biological molecules from a host cell or of the growth medium thereof. Generally, the term "isolated" is not intended to refer to a complete absence of such biological molecules or to an absence of water, buffers, or salts or to components of a pharmaceutical formulation that includes the antibodies or fragments.

The present invention includes monoclonal anti-LAG3 antibodies and antigen-binding fragments thereof as well as monoclonal compositions comprising a plurality of isolated monoclonal antibodies. The term "monoclonal antibody", as used herein, refers to a population of substantially homogeneous antibodies, i.e., the antibody molecules comprising the population are identical in amino acid sequence except for possible naturally occurring mutations that may be present in minor amounts. A "plurality" of such monoclonal antibodies and fragments in a composition refers to a concentration of identical (i.e., as discussed above, in amino acid sequence except for possible naturally occurring mutations that may be present in minor amounts) antibodies and fragments which is above that which would normally occur in nature, e.g., in the blood of a host organism such as a mouse or a human. In contrast, conventional (polyclonal) antibody preparations typically include a multitude of different antibodies having different amino acid sequences in their variable domains, particularly their CDRs, that are often specific for different epitopes. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler et al. (1975) Nature 256: 495, or may be made by recombinant DNA methods (see, e.g., U.S. Pat. No. 4,816,567). The "monoclonal antibodies" may also be isolated from phage antibody libraries using the techniques described in Clackson et al. (1991) Nature 352: 624-628 and Marks et al. (1991) J. Mol. Biol. 222: 581-597, for example. See also Presta (2005) J. Allergy Clin. Immunol. 116:731.

The present invention includes anti-LAG3 chimeric antibodies (e.g., human constant domain/mouse variable domain) and methods of use thereof. As used herein, a "chimeric antibody" is an antibody having the variable domain from a first antibody and the constant domain from a second antibody, where the first and second antibodies are from different species. (U.S. Pat. No. 4,816,567; and Morrison et al., (1984) Proc. Natl. Acad. Sci. USA 81: 6851-6855). Typically, the variable domains are obtained from an antibody from an experimental animal (the "parental antibody"), such as a rodent, and the constant domain sequences are obtained from human antibodies, so that the resulting chimeric antibody will be less likely to elicit an adverse immune response in a human subject than the parental (e.g., mouse) antibody.

The present invention includes anti-LAG3 humanized antibodies and antigen-binding fragments thereof (e.g., mouse antibodies that have been humanized) and methods of use thereof. As used herein, the term "humanized antibody" refers to forms of antibodies that contain sequences from both human and non-human (e.g., mouse or rat) antibodies. In general, the humanized antibody will comprise substantially all of at least one, and typically two, variable domains, in which all or substantially all of the hypervariable loops correspond to those of a non-human immunoglobulin, and all or substantially all of the framework (FR) regions are those of a human immunoglobulin sequence. The humanized antibody may optionally comprise at least a portion of a human immunoglobulin constant region (Fc).

The present invention includes anti-LAG3 fully human antibodies and antigen-binding fragments thereof and methods of use thereof. The term "fully human antibody" refers to an antibody that comprises human immunoglobulin protein sequences only. A fully human antibody may contain murine carbohydrate chains if produced in a mouse, in a mouse cell, or in a hybridoma derived from a mouse cell. Similarly, "mouse antibody" refers to an antibody that comprises mouse immunoglobulin sequences only. Alternatively, a fully human antibody may contain rat carbohydrate chains if produced in a rat, in a rat cell, or in a hybridoma derived from a rat cell. Similarly, "rat antibody" refers to an antibody that comprises rat immunoglobulin sequences only. In an embodiment of the invention, an fully human anti-LAG3 antibody or antigen-binding fragment thereof is the product of isolation from a transgenic animal, e.g., a mouse (e.g., a HUMAB mouse, see e.g., U.S. Pat. Nos. 5,545,806; 5,569,825; 5,625,126; 5,633,425; 5,661,016; 5,770,429; 5,789,650; 5,814,318; 5,874,299 and 5,877,397; and Harding, et al., (1995) Ann. NY Acad. Sci. 764:536 546; or a XENOMOUSE, see e.g., Green et al., 1999, J. Immunol. Methods 231:11-23), which has been genetically modified to have fully human immunoglobulin genes; or the product of isolation from a phage or virus which expresses the immunoglobulin chains of the anti-LAG3 fully human antibody or antigen-binding fragment thereof.

In general, the basic antibody structural unit comprises a tetramer. Each tetramer includes two identical pairs of polypeptide chains, each pair having one "light" (about 25 kDa) and one "heavy" chain (about 50-70 kDa). The amino-terminal portion of each chain includes a variable region of about 100 to 110 or more amino acids primarily responsible for antigen recognition. The carboxy-terminal portion of the heavy chain may define a constant region primarily responsible for effector function. Typically, human light chains are classified as kappa and lambda light chains. Furthermore, human heavy chains are typically classified as mu, delta, gamma, alpha, or epsilon, and define the antibody's isotype as IgM, IgD, IgG, IgA, and IgE, respectively. Within light and heavy chains, the variable and constant regions are joined by a "J" region of about 12 or more amino acids, with the heavy chain also including a "D" region of about 10 more amino acids. See generally, Fundamental Immunology Ch. 7 (Paul, W., ed., 2nd ed. Raven Press, N.Y. (1989).

In an embodiment of the invention, anti-LAG3 antibodies of the present invention comprise a full tetrameric structure having two light chains and two heavy chains, including constant regions.

The variable regions of each light/heavy chain pair form the antibody binding site. Thus, in general, an intact antibody has two binding sites. Except in bifunctional or bispecific antibodies, the two binding sites are, in general, the same.

Typically, the variable domains of both the heavy and light chains comprise three hypervariable regions, also called complementarity determining regions (CDRs), located within relatively conserved framework regions (FR). The CDRs are usually aligned by the framework regions, enabling binding to a specific epitope. In general, from N-terminal to C-terminal, both light and heavy chains variable domains comprise FR1, CDR1, FR2, CDR2, FR3, CDR3 and FR4. The assignment of amino acids to each domain is, generally, in accordance with the definitions of Sequences of Proteins of Immunological Interest, Kabat, et al.; National Institutes of Health, Bethesda, Md.; 5$^{th}$ ed.; NIH Publ. No. 91-3242 (1991); Kabat (1978) Adv. Prot. Chem. 32:1-75; Kabat, et al., (1977) J. Biol. Chem. 252: 6609-6616; Chothia, et al., (1987) J Mol. Biol. 196:901-917 or Chothia, et al., (1989) Nature 342:878-883.

As used herein, the term "hypervariable region" refers to the amino acid residues of an antibody or antigen-binding fragment thereof that are responsible for antigen-binding. The hypervariable region comprises amino acid residues from a "complementarity determining region" or "CDR" (i.e. CDR-L1, CDR-L2 and CDR-L3 in the light chain variable domain and CDR-H1, CDR-H2 and CDR-H3 in the heavy chain variable domain). See Kabat et al. (1991) Sequences of Proteins of Immunological Interest, 5th Ed. Public Health Service, National Institutes of Health, Bethesda, Md.; Johnson et al. (2001) Nucleic Acids Res. 2001; 29(1): 205-206 (defining the CDR regions of an antibody by sequence); see also Chothia and Lesk (1987) *J. Mol. Biol.* 196: 901-917; Chothia et al. Nature 342, 877 (1989), and Tramontano et al. J. Mol. Biol. 215, 175 (1990) (defining the CDR regions of an antibody by structure); see also Macallum et al. J Mol Biol. 1996 Oct. 11; 262(5):732-45. As used herein, the term "framework" or "FR" residues refers to those variable domain residues other than the hypervariable region residues defined herein as CDR residues.

The scope of the present invention, includes anti-LAG3 antibodies and antigen-binding fragments thereof that specifically bind LAG3, which have any combination of CDRs from the immunoglobulin light chains of SEQ ID NOs: 7, 17, 27 and/or 37 and/or which have any combination of CDRs from the immunoglobulin heavy chains of SEQ ID NOs: 2, 12, 22 and 32 wherein the CDRs are as defined by Kabat and Chothia (see above).

"Homology" refers to sequence similarity between two polynucleotide sequences or between two polypeptide sequences when they are optimally aligned. When a position in both of the two compared sequences is occupied by the same base or amino acid monomer subunit, e.g., if a position in each of two DNA molecules is occupied by adenine, then the molecules are homologous at that position. The percent of homology is the number of homologous positions shared by the two sequences divided by the total number of positions compared×100. For example, if 6 of 10 of the positions in two sequences are matched or homologous when the sequences are optimally aligned then the two sequences are 60% homologous. Generally, the comparison is made when two sequences are aligned to give maximum percent homology.

"Isolated nucleic acid molecules" or "isolated polynucleotides" (e.g., DNA or RNA) is also not associated with all or a portion of a polynucleotide in which the isolated polynucleotide is found in nature, or is linked to a polynucleotide to which it is not linked in nature. For purposes of this disclosure, it should be understood that "a nucleic acid molecule comprising" a particular nucleotide sequence does not encompass intact chromosomes. Isolated nucleic acid molecules "comprising" specified nucleic acid sequences may include, in addition to the specified sequences, coding sequences for up to ten or even up to twenty or more other proteins or portions or fragments thereof, or may include operably linked regulatory sequences that control expression of the coding region of the recited nucleic acid sequences, and/or may include vector sequences. As is discussed below, the present invention includes isolated polynucleotides encoding any of the immunoglobulin chains discussed herein.

The phrase "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to use promoters, polyadenylation signals, and enhancers.

A nucleic acid or polynucleotide is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, but not always, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

As used herein, the expressions "cell," and "cell line," are used interchangeably and all such designations include progeny. Thus, the words "transformants" and "transformed cells" include the primary subject cell and cultures derived therefrom without regard for the number of transfers. It is also understood that not all progeny will have precisely identical DNA content, due to deliberate or inadvertent mutations. Mutant progeny that have the same function or biological activity as screened for in the originally transformed cell are included. Where distinct designations are intended, it will be clear from the context.

As used herein, "polymerase chain reaction" or "PCR" refers to a procedure or technique in which specific nucleic acid sequences, RNA and/or DNA, are amplified as described in, e.g., U.S. Pat. No. 4,683,195. Generally, sequence information from the ends of the region of interest or beyond is used to design oligonucleotide primers. These primers will be identical or similar in sequence to opposite strands of the template to be amplified. The 5' terminal nucleotides of the two primers can coincide with the ends of the amplified material. PCR can be used to amplify specific RNA sequences, specific DNA sequences from total genomic DNA, and cDNA transcribed from total cellular RNA, bacteriophage or plasmid sequences, etc. See generally Mullis et al. (1987) *Cold Spring Harbor Symp. Quant. Biol.* 51:263; Erlich, ed., (1989) PCR TECHNOLOGY (Stockton Press, N.Y.) As used herein, PCR is considered to be one, but not the only, example of a nucleic acid polymerase reaction method for amplifying a nucleic acid test sample comprising the use of a known nucleic acid as a primer and a nucleic acid polymerase to amplify or generate a specific piece of nucleic acid.

As used herein, "germline sequence" refers to a sequence of unrearranged immunoglobulin DNA sequences. Any suitable source of unrearranged immunoglobulin sequences may be used. Human germline sequences may be obtained, for example, from JOINSOLVER germline databases on the website for the National Institute of Arthritis and Musculoskeletal and Skin Diseases of the United States National Institutes of Health. Mouse germline sequences may be obtained, for example, as described in Giudicelli et al. (2005) *Nucleic Acids Res.* 33:D256-D261.

Physical and Functional Properties of the Exemplary Anti-LAG3 Antibodies

The present invention provides anti-LAG3 antibodies and antigen-binding fragments thereof (e.g., humanized antibodies such as antagonist humanized antibodies) and methods of use of the antibodies or antigen-binding fragments thereof in the treatment or prevention of disease. In one embodiment, the invention provides for mouse or humanized anti-LAG3 antibodies and antigen-binding fragments thereof and methods of use of the antibodies or antigen-binding fragments thereof in the treatment or prevention of disease. In one embodiment, the invention provides for antagonistic anti-LAG3 antibodies and methods of use of the antibodies or antigen-binding fragments thereof in the treatment or prevention of disease.

Herein, an anti-LAG3 antibody or antigen-binding fragment thereof comprising a particular light chain and a particular heavy chain may be referred to as "light chain/heavy chain"; for example, an antibody comprising the 45AGX_22D2_VL3 light chain and the Humanizedx [LAG3_H] mAb.22D2 VH6 N54D heavy chain may be referred to as "45AGX_22D2_VL3/Humanizedx[LAG3_H] mAb.22D2 VH6 N54D".

An "anti-LAG3 antibody or antigen-binding fragment thereof" of the present invention includes any antibody or antigen-binding fragment thereof that is discussed herein (e.g., 4A10, 19E8, 11C9 and/or 22D2; e.g., Ab1, Ab2, Ab3, Ab4, Ab5, Ab6, Ab7, Ab8 and/or Ab9) which specifically binds to LAG3 (e.g., human or cynomolgous monkey LAG3). Such antibodies and fragments include humanized antibodies and fragments having any combination of the mouse or humanized light and heavy chains that are set forth herein or variants of such chains which specifically bind LAG3. Such antibodies and fragments include any antibody or fragment comprising any one or more of the CDRs (e.g., CDR-L1, CDR-L2, CDR-L3, CDR-H1, CDR-H2 and CDR-H3) of the mouse or humanized chains set forth herein or variants of such CDRs which specifically bind LAG3. Furthermore, an anti-LAG3 antibody or antigen-binding fragment thereof of the present invention includes any antibody or antigen-binding fragment thereof that binds to the same epitope in LAG3 to which the antibodies and fragments discussed herein bind and any antibody or antigen-binding fragment that cross-blocks (partially or fully) or is cross-blocked (partially or fully) by an antibody or fragment discussed herein for LAG3 binding; as well as any variant thereof. A particular embodiment of the invention includes antibodies and fragments comprising only mouse immunoglobulin chains or only humanized immunoglobulin chains and/or wherein the immunoglobulin chains or CDRs are all derived, directly or indirectly, from the same original mouse clone, i.e., humanized 4A10 light chains paired with humanized 4A10 heavy chains; humanized 19E8 light chains paired with humanized 19E8 heavy chains; humanized 11C9 light chains paired with humanized 11C9 heavy chains; or humanized 22D2 light chains paired with humanized 22D2 heavy chains; or mouse 4A10 light chains paired with mouse 4A10 heavy chains; mouse 19E8 light chains paired with mouse 19E8 heavy chains; mouse 11C9 light chains paired with mouse 11C9 heavy chains; or mouse 22D2 light chains paired with mouse 22D2 heavy chains. These antibodies and fragments are part of the present invention along with their uses, e.g., as set forth herein.

The cross-blocking antibodies and antigen-binding fragments thereof discussed herein can be identified based on their ability to block any of the antibodies or fragments specifically set forth herein, e.g., Ab1, Ab2, Ab3, Ab4, Ab5, Ab6, Ab7, Ab8, Ab9, 4A10, 19E8, 11C9 and/or 22D2, from binding to LAG3, in binding assays (e.g., bio-layer interferometry (BLI; for example FORTEBIO OCTET binding assay; Pall ForteBio Corp; Menlo Park, Calif.), surface plasmon resonance (SPR), BIACore, ELISA, flow cytometry). For example, in an embodiment of the invention, when using BLI, the tip of a fiber-optic probe is coated with ligand (e.g., LAG3) and acts as the biosensor wherein binding of anti-LAG3 antibody or antigen-binding fragment to the LAG3 alters the interference pattern of white light reflected from the probe layer bound to LAG3 and an internal reference layer. The shift is indicative of LAG3/anti-LAG3 binding. In an embodiment of the invention, the LAG3 coated tip is immersed in a solution of analyte containing antibody or antigen-binding fragment, e.g., in the well of either a 96- or 384-well plate. In an embodiment of the invention, the plate is shaken during reading to create orbital flow. To read the assay, white light is directed down the length of the fiber. As mentioned above, interference between light reflecting off the reference layer and immobilized surfaces containing LAG3 of the tip creates a distinctive pattern of light returning up the fiber. As molecules bind to the immobilized sensor surface, that pattern changes in proportion to the extent of binding. For example, assays can be used in which a LAG3 (e.g., human LAG3) protein is immobilized on a BLI probe or plate, a reference anti-LAG3 antibody or fragment binds to LAG3 (e.g., at saturating concentration) and a test anti-LAG3 antibody or fragment is added. The ability of the test antibody to compete with the reference antibody for LAG3 binding is then determined. In the BLI format, light interference of the LAG3 complex is monitored to determine if the test antibody effectively competes with the reference antibody, e.g., nanometers of light wavelength shift over time is monitored wherein a shift indicates additional binding of the test antibody and a lack of cross-blocking. In an embodiment of the invention, in the BLI format, cross-blocking is qualitatively deemed to have occurred between the antibodies if no additional binding of test antibody is observed. In an embodiment of the invention, as a control, cross-blocking of the reference antibody with itself is confirmed; wherein the assay is determined to be operating correctly if the reference antibody can cross-block itself from LAG3 binding. The ability of a test antibody to inhibit the binding of, for example, Ab1, Ab2, Ab3, Ab4, Ab5, Ab6, Ab7, Ab8, Ab9, 4A10, 19E8, 11C9 and/or 22D2, to LAG3 (e.g., human LAG3) demonstrates that the test antibody can cross-block Ab1, Ab2, Ab3, Ab4, Ab5, Ab6, Ab7, Ab8, Ab9, 4A10, 19E8, 11C9 and/or 22D2 for binding to LAG3 (e.g., human LAG3) and thus, may, in some cases, bind to the same epitope on LAG3 (e.g., human LAG3) as Ab1, Ab2, Ab3, Ab4, Ab5, Ab6, Ab7, Ab8, Ab9, 4A10, 19E8, 11C9 and/or 22D2. As stated above, antibodies and fragments that bind to the same epitope as any of the anti-LAG3 antibodies or fragments of the present invention also form part of the present invention. In an embodiment of the invention, BLI is conducted in a sandwich format wherein a reference anti-LAG3 antibody or antigen-binding fragment is immobilized to the probe and then bound with LAG3. Test anti-LAG3 antibody or antigen-binding fragment is then tested for the ability to block binding of the references antibody or fragment.

"4A10", "19E8", "11C9" and "22D2" anti-LAG3 antibodies and antigen-binding fragments thereof referred to herein comprise the CDR-L1, CDR-L2 and CDR-L3 of the mouse immunoglobulin light chains 4A10, 19E8, 11C9 or 22D2 and variants thereof, respectively; as well as CDR-H1, CDR-H2 and CDR-H3 of the mouse immunoglobulin heavy chains 4A10, 19E8, 11C9 or 22D2, and variants thereof, respectively. Such "4A10", "19E8", "11C9" and "22D2" antibodies and fragments may be humanized antibodies or antigen-binding fragments thereof such as Ab1, Ab2, Ab3, Ab4, Ab5, Ab6, Ab7, Ab8 or Ab9.

Examples of the immunoglobulin chains of anti-LAG3 antibodies as well as their CDRs include, but are not limited to:

4A10-V$_H$ sequence
ATGAAATGCAGCTGGGTCATCTTCTTCCTGATGGCAGTGGTTATAGGAATCAATTCAGAGGTTCAGCTGCTCCAGTC TGGGGCAGAACTTGTGAGGTCAGGGGCCTCAGTCAAGTTGTCCTGCACAGCCTCT<u>GGCTTCAACATTGAAGACTACT</u>

<u>ATATGCAC</u>TGGATGAAACAGAGGCCTGAACAGGGCCTGGAGTGGATTGGA<u>TGGATTGATCCTGTGAATGGTGATACT</u>

<u>GAATATGCCCCGAAGTTCCAGGGC</u>AAGGCCACTATGACTGCAGACACATCCTCCAACACAGCCTACTACACCTCAA

CAGCCTGACATCTGAGGACACTGCCGTCTATTACTGTAATTTC<u>TATGATGGTTACCTCTTTGCTTTC</u>TGGGGCCAAG

GGACCCTGGTCACTGTCTCTGCA
(SEQ ID NO: 1; wherein the CDRs are underscored and wherein the signal
sequence is in bold font)

MKCSWVIFFLMAVVIGINSEVQLLQSGAELVRSGASVKLSCTAS<u>GFNIEDYYMH</u>WMKQRPEQGLEWIG<u>WIDPVNGDT</u>

<u>EYAPKFQG</u>KATM<u>TADTSSNTAYLHL<u>NSL</u>TSEDTAVYYCN<u>FYDGYLFAF</u>WGQGTLVTVSA
(SEQ ID NO: 2; wherein the CDRs are underscored and wherein the signal sequence is in bold
font)

CDR-H1: GFNIEDYYMH (SEQ ID NO: 3)

CDR-H2: WIDPVNGDTEYAPKFQG (SEQ ID NO: 4)

CDR-H3: YDGYLFAF (SEQ ID NO: 5)

4A10-V$_L$ sequence
ATGAGGTGCCTAGCTGAGTTCCTGGGGCTGCTTGTGCTCTGGATCCCTGGAGCCATTGGGGATATTGTGCTGACTCA GGCTGCACCCTCTGTACCTGTCACTCCTGGAGAGTCAGTGTCCATCTCCTGC<u>AGGTCTAGTAAGAGTCTCCTGCATA GTGATGGCAACACTTATCTGTAT</u>TGGCTCCTGCAGAGGCCAGGCCAGTCTCCTCAGCTCCTGATATAT<u>CGGATGTCC AACCTTGCCTCA</u>GGGGTCCCAGACAGGTTCAGCGGCAGTGGGTCAGGAACTGTTTTCACACTGAGAATCAGCAGACT GGAGGCTGAGGATGTGGGTATTTATTACTGT<u>ATGCAACATCTAGAATATCCTTTCACG</u>TTTGGAGGGGGGACCAAGC TGGAAATAAAA
(SEQ ID NO: 6; wherein the CDRs are underscored and wherein the signal sequence is in bold
font)

MRCLAEFLGLLVLWIPGAIGDIVLTQAAPSVPVTPGESVSISC<u>RSSKSLLHSDGNTYLY</u>WLLQRPGQSPQLLIY<u>RMS

NLAS</u>GVPDRFSGSGSGTVFTLRISRLEAEDVGIYYC<u>MQHLEYPFT</u>FGGGTKLEIK
(SEQ ID NO: 7; wherein the CDRs are underscored and wherein the signal sequence is in bold
font)

CDR-L1: RS SKSLLHSDGNTYLY (SEQ ID NO: 8)

CDR-L2: YRMSNLAS (SEQ ID NO: 9)

CDR-L3: MQHLEYPFT (SEQ ID NO: 10)

19E8-V$_H$ sequence
ATGGGATGGAGCTGGATCTTTCTTTTCCTCCTGTCAGGAACTGCAGGTGTCCGTTGCCAGATCCGACTGCAGCAGTC TGGACCTGAGCTGGTGAAGCCTGGGGCTTCAGTGAAGATATCCTGCAAGGCTTCT<u>GGGTCCTCCTTCACTGACTACT ATATAAAC</u>TGGGTGAAGCAGAAGCCTGGACAGGGACTTGAGTGGATTGGA<u>TGGATTTATCCTGGAAGCGGTAATTCT ATCTACAATGAGAACTTCAAGGCC</u>AAGGCCACATTGACTGTAGACACATCCTCCAGCACAGCCTACATGCATCTCAG CAGCCTGACATCTGAGGACACTGCTGTCTATTTCTGTGCAAGA<u>GAGGCTGATTACGACGATGCTTTGGACTAC</u>TGGG GTCAAGGAACCTCGGTCACCGTCTCCTCA
(SEQ ID NO: 11; wherein the CDRs are underscored and wherein the signal sequence is in bold
font)

MGWSWIFLFLLSGTAGVRCQIRLQQSGPELVKPGASVKISCKAS<u>GSSFTDYYIN</u>WVKQKPGQGLEWIG<u>WIYPGSGNS

IYNENFKA</u>KATLTVDTSSSTAYMHLSSLTSEDTAVYFCAR<u>EADYDDALDY</u>WGQGTSVTVSS
(SEQ ID NO: 12; wherein the CDRs are underscored and wherein the signal sequence is in bold
font)

CDR-H1: GSSFTDYYIN (SEQ ID NO: 13)

CDR-H2: WIYPGSGNSIYNENFKA (SEQ ID NO: 14)

CDR-H3: EADYDDALDY (SEQ ID NO: 15)

-continued

19E8-V_L sequence
ATGGTATCCACACCTCAGTTCCTTGTATTTTTGCTTTTCTGGATTCCAGCCTCCAGAGGTCACATCTTGCTGACTCA GTCTCCAGCCATTCTGTCTGTGAGTCCAGGAGAAAGAGTCAGTTTCTCCTGC<u>AGGGCCAGTCAGAGCATTGGCACAA</u>

<u>GCATACAC</u>TGGTATCAGCAAAGAACAAATGGTTCTCCAAGGCTTCTCATAAAG<u>TATGCTTCTGAGTCTATCTCTGGG</u>

ATCCCTTCCAGGTTTAGTGGCAGTGGATCAGGGACAGATTTTACTCTTAGCATCAACAGTGTGGAGTCAGAAGATAT

TGCAGATTATTACTGT<u>CAACAAAGTAATAGCTGGCCAACGTACAC</u>GTTCGGAGGGGGACCAAGCTGGAAATAAAA
(SEQ ID NO: 16; wherein the CDRs are underscored and wherein the signal sequence is in bold font)

MVSTPQFLVFLLFWIPASRGHILLTQSPAILSVSPGERVSFSC<u>RASQSIGTSIH</u>WYQQRT<u>NG</u>

<u>SPRLLIK</u><u>YASESIS</u>GIPSRFSGSGSGTDFTLS<u>INS</u>VESEDIADYYC<u>QQSNS WPTYT</u>FGGGTKLEIK
(SEQ ID NO: 17; wherein the CDRs are underscored and wherein the signal sequence is in bold font)

CDR-L1: RASQSIGTSIH (SEQ ID NO: 18)

CDR-L2: YASESIS (SEQ ID NO: 19)

CDR-L3: QQSNSWPTYT (SEQ ID NO: 20)

11C9-V_H sequence
ATGAGATGGAGCTGTATCATCCTCTTCTTGGTAGCAACAGCTACAGGTGTCAACTCCCAGGTCCAACTGCAGCAGCC TGGGGCTGAGCTTGTGATGCCTGGGGCTTCAGCGAAGATGTCCTGCAAGGCTTCT<u>GGCTACACACTCACTGACTACT</u>

<u>GGATGCAC</u>TGGGTGAAGCAGAGGCCTGGACAAGGCCTTGAGTGGATCGG<u>AGCGATTGATATTTCTGATAGTTATTCT</u>

<u>AGCTACAATCAAAAGTTCAAGGGC</u>AAGGCCACATTGACTGTAGACGAATCCTCCAGCACAGCCTACATGCAGCTCAC

CAGCCTGACATCTGAGGACTCTGCGGTCTATTACTGTGCAAGA<u>TCCCCTTTCTACAATAGTAGAGGGGGGAACTACT</u>

<u>TTGACTAC</u>TGGGGCCAAGGCACCACTCTCACAGTCTCCTCA
(SEQ ID NO: 21; wherein the CDRs are underscored and wherein the signal sequence is in bold font)

MRWSCIILFLVATATGVNSQVQLQQPGAELV<u>M</u>PGASAK<u>M</u>SCKAS<u>GYTLTDYW</u>

<u>MH</u>WVKQRPGQGLEWIG<u>AIDISDSYSSYNQKFKG</u>KATLTVDESSSTAY<u>M</u>QLTSLTSEDSAVYYCAR<u>SPFYNSRGGNYF</u>

<u>DY</u>WGQGTTLTVSS
(SEQ ID NO: 22; wherein the CDRs are underscored and wherein the signal sequence is in bold font)

CDR-H1: GYTLTDYWMH (SEQ ID NO: 23)

CDR-H2: AIDISDSYSSYNQKFKG (SEQ ID NO: 24)

CDR-H3: SPFYNSRGGNYFDY (SEQ ID NO: 25)

11C9-V_L sequence
ATGATGTCCTCTGCTCAGTTCCTTGGTCTCCTGTTGCTCTGTTTTCAAGGTACCAGATGTGATATCCAGATGACACA GACTACATCCTCCCTGTCTGCCTCTCTGGGAGACAGAGTCACCATCAGTTGC<u>AGGGCAAGTCAGGACATTAGCAATT</u>

<u>ATTTAAAC</u>TGGTATCAGCAGAAACCAGATGGAACTGTTAAACTCCTGATCTAC<u>TACACATCAAGATTACACTCAGGA</u>

GTCCCATCAAGGTTCAGTGGCAGTGGGTCTGGAACAGATTATTCTCTCACCATTAGCAACCTGGAGCAAGAAGATAT

TGCCACTTACTTTTGC<u>CAACAGGGTGATACGCTTCCTCCGTGGACG</u>TTCGGTGGAGGCACCAAGCTGGAAATCAAA
(SEQ ID NO: 26; wherein the CDRs are underscored and wherein the signal sequence is in bold font)

MMSSAQFLGLLLLCFQGTRCDIQMTQTTSSLSASLGDRVTISC<u>RASQDISNYLN</u>WYQQKPDGTVKLLIY<u>YTSRLHS</u>G

VPSRFSGSGSGTDYSLTISNLEQEDIATYFC<u>QQGDTLPPWT</u>EGGGTKLEIK
(SEQ ID NO: 27; wherein the CDRs are underscored and wherein the signal sequence is in bold font)

CDR-L1: RASQDISNYLN (SEQ ID NO: 28)

CDR-L2: YTSRLHS (SEQ ID NO: 29)

CDR-L3: QQGDTLPPWT (SEQ ID NO: 30)

22D2-V$_H$ sequence
ATGGGATGGACCTGGATCTTTCTCTTCTTCCTGTCAGGAACTGCAGGTGTCCTCTCTGAGGTCCTGCTGCTACAGTC TGGACCTGAACTGGTGAAGCCTGGGACTTCAGTGAAAATCCCCTGCAAGGCTTCT<u>GGATACACATTCACTGACTACA</u>

<u>ACGTGGAC</u>TGGGTGAAGCAGCGCCATGGAAAGGGCCTTGAGTGGATTGGA<u>GATATTAATCCAAACAATGGTGGTACT</u>

<u>ATCTACAGTCAGAAATTCAAGGGC</u>AAGGCCACATTGACTGTTGACAAGTCCTCCAGCACAGCCTTCATGGAGCTCCG

CAGCCTGACATCTGAGGACACTGCAGTCTATTTCTGTGCAAGG<u>AACTATAGGTGGTTTGGTGCTATGGAC</u>CACTGGG

GTCAAGGAACCTCAGTCACCGTCTCCTCAGCCAAAACAACAGCCCCATCGGTCTATCCACTG
(SEQ ID NO: 31; wherein the CDRs are underscored and wherein the signal sequence is in bold font)

MGWTWIFLFFLSGTAGVLSEVLLLQSGPELVKPGTSVKIPCKASGYTFT<u>DYNVD</u>WVKQRHGKGLEWIG<u>DINPN</u>

<u>NGGTIYSQKFKG</u>KATLTVDKSSSTAFMELRSLTSEDTAVYFCAR<u>NYRWFGAMDH</u>WGQGTSVTVSS
(SEQ ID NO: 32; wherein the CDRs are underscored and wherein the signal sequence is in bold font)

CDR-H1: DYNVD (SEQ ID NO: 33)

CDR-H2: DINPNNGGTIYSQKFKG (SEQ ID NO: 34)

CDR-H3: NYRWFGAMDH (SEQ ID NO: 35)

22D2-V$_L$ sequence
ATGGAGACAGACACAATCCTGCTATGGGTGCTGCTGCTCTGGGTTCCAGGTTCCACTGGTGACATTGTGTTGACCCA ATCTCCAGCTTCTTTGGCTGTGTCTCCAGGGCAGAGGGCCACCATTTCCTGC<u>AAGGCCAGTCAAAGTCTTGATTATG</u>

<u>AAGGTGATAGTGATATGAAT</u>TGGTACCAACAGAAACCAGGACAGCCACCCAGACTCCTCATCTCT<u>GGTGCATCCAAT</u>

<u>CTAGAGTCT</u>GGGATCCCAGCCAGGTTCAGTGGCAGTGGGTCTGGGACAGACTTCACTGTTAACATCCATCCTGTGGA

GGAGGAGGATGCTGCAACCTATTACTGT<u>CAGCAAAGTACTGAGGATCCTCGGACG</u>TTCGGTGGAGGCACCAAGCTGG

AAATCAAACGGGCTGATGCTGCACCAACTGTATCCATCTTCCCACCATCCAGTGAGCAGTTAACATCTGGAGGTGCC

TCAGTCGTGTGCTTCTTGAACAACTTCTACCCCAAAGACATCAATGTCAAGTGGAAGATTGATGGCAGTGAACGACA

AAATGGCG
(SEQ ID NO: 36; wherein the CDRs are underscored and wherein the signal sequence is in bold font)

METDTILLWVLLLWVPGSTGDIVLTQSPASLAVSPGQRATISC<u>KASQSLDYEGDSDMN</u>WYQQKPGQPPRLLIS<u>GASN</u>

<u>LES</u>GIPARFSGSGSGTDFTVNIHPVEEEDAATYYC<u>QQSTEDPRT</u>FGGGTKLEIK
(SEQ ID NO: 37; wherein the CDRs are underscored and wherein the signal sequence is in bold font)

CDR-L1: KASQSLDYEGDSDMN (SEQ ID NO: 38)

CDR-L2: GASNLES (SEQ ID NO: 39)

CDR-L3: QQSTEDPRT (SEQ ID NO: 40)

The 22D2 mouse parental heavy or light chains may be referred to herein as LB145.22D2.E1.1D1. The 19E8 mouse parental heavy or light chains may be referred to herein as LB148.19E8.G1.1A1. The 4A10 mouse parental heavy or light chains may be referred to herein as LB148.4A10.1H1. The 11C9 mouse parental heavy or light chains may be referred to herein as LB148.11C9.1C1.

The present invention also includes any anti-LAG3 antibody or antigen-binding fragment thereof (e.g., humanized antibodies such as antagonist humanized antibodies) comprising one or more of the heavy and/or light chains (or variants thereof) or CDRs (or variants thereof) or mature fragments of such chains (or variants thereof) or variable domains thereof of such chains (or variants thereof) which are set for the below. Light chains may be designated with a "V$_L$" or "VK" and heavy chains may be designated with a "V$_H$".

Mouse Immunoglobulin Chains

Chains set forth below having a "4A10", "19E8", "11C9" or "22D2" designation may be referred to as such herein. As discussed herein, the scope of the present invention includes anti-LAG3 antibodies (e.g., humanized antibodies such as humanized antagonistic antibodies) and antigen-binding fragments thereof comprising any one or more (e.g., 3) light chain CDRs and/or any one or more (e.g., 3) heavy chain CDRs from the immunoglobulin chains set forth below; or any mature variable domain of a light immunoglobulin chain and/or mature variable domain of a heavy immunoglobulin chain set forth in SEQ ID NOs: 45-104.

Humanized Chains

In an embodiment of the invention, a humanized (e.g., humanized antagonistic) anti-LAG3 antibody or antigen-binding fragment of the invention comprises any combination of heavy and light mature, variable domains of the following immunoglobulin chains. In an embodiment of the invention, the 11C9 humanized light chains are paired with the 11C9 humanized heavy chains; the 19E8 humanized light chains are paired with the 19E8 humanized heavy chains; the 4A10 humanized light chains are paired with the 4A10 humanized heavy chains; and the 22D2 humanized light chains are paired with the 22D2 humanized heavy chains. In an embodiment of the invention, a humanized anti-LAG3 antibody or antigen-binding fragment thereof comprises a "45AGX_22D2_VL3" immunoglobulin variable domain light chain, e.g., comprising the amino acid sequence of SEQ ID NO: 274 or a mature fragment thereof (e.g., amino acids 21-131 of SEQ ID NO: 274); and a "Humanizedx[LAG3_H] mAb.22D2 VH6 N54D" or "Humanizedx[LAG3_H] mAb.22D2 VH6 N54G" immunoglobulin variable domain heavy chain comprising the amino acid sequence of SEQ ID NO: 426 or SEQ ID NO: 427, respectively.

Chains set forth below having a "4A10", "19E8", "11C9" or "22D2" designation may be referred to as such herein. As discussed herein, the scope of the present invention includes anti-LAG3 antibodies (e.g., humanized antibodies such as humanized antagonistic antibodies) and antigen-binding fragments thereof comprising any one or more (e.g., 3) light chain CDRs and/or any one or more (e.g., 3) heavy chain CDRs from the immunoglobulin chains set forth herein; or any mature or unprocessed $V_L$ domain or light chain immunoglobulin and/or mature or unprocessed $V_H$ domain or heavy chain immunoglobulin set forth herein. The scope of the present invention also includes any of the humanized polypeptides or polynucleotides or variable domains thereof having 1, 2, 3, 4, 5, 6, 7, 8, 9 or 10 point mutations or point deletions.

Specific embodiments of the invention include any humanized anti-LAG3 antibodies and antigen-binding fragments thereof comprising the immunoglobulin light and heavy chains set forth below or any antibody or fragment having the light and heavy chain CDRs thereof (e.g., IgG1 or IgG4). Such antibodies and fragments may be referred to as any one of Ab1, Ab2, Ab3, Ab4, Ab5, Ab6, Ab7, Ab8 or Ab9 as follows:

Ab1: humanized light chain 45AGX Humanizedx [LAG3_H] mAb (LB145.22D2.E1.D1 (VL3)) Kappa (PX) (or the variable domain thereof) and humanized heavy chain 53AHH Humanizedx[LAG3_H] mAb (LB145.22D2.E1.D1 VH6) IgG1/Kappa (PX) (or the variable domain thereof); for example comprising:

```
a light chain immunoglobulin comprising the amino
acid sequence:
DIVMTQTPLSLSVTPGQPASISCKASQSLDYEGDSDMNWYLQKPGQPPQL

LIYGASNLESGVPDRFSGSGSGTDFTLKISRVEAEDVGVYYCQQSTEDPR

TFGGGTKVEIKRTVAAPSVFIFPPSDEQLKSGTASVVCLLNNFYPREAKV

QWKVDNALQSGNSQESVTEQDSKDSTYSLSSTLTLSKADYEKHKVYACEV

THQGLSSPVTKSFNRGEC(amino acids 21-238 of SEQ ID
NO: 126);
and a heavy chain immunoglobulin comprising the amino
acid sequence:
                              (SEQ ID NO: 106)
QMQLVQSGPEVKKPGTSVKVSCKASGYTFTDYNVDWVRQARGQRLEWIGD

INPNNGGTIYAQKFQERVTITVDKSTSTAYMELSSLRSEDTAVYYCARNY

RWFGAMDHWGQGTTVTVSSASTKGPSVFPLAPSSKSTSGGTAALGCLVKD
```

```
YFPEPVTVSWNSGALTSGVHTFPAVLQSSGLYSLSSVVTVPSSSLGTQTY

ICNVNHKPSNTKVDKKVEPKSCDKTHTCPPCPAPELLGGPSVFLFPPKPK

DTLMISRTPEVTCVVVDVSHEDPEVKFNWYVDGVEVHNAKTKPREEQYNS

TYRVVSVLTVLHQDWLNGKEYKCKVSNKALPAPIEKTISKAKGQPREPQV

YTLPPSRDELTKNQVSLTCLVKGFYPSDIAVEWESNGQPENNYKTTPPVL

DSDGSFFLYSKLTVDKSRWQQGNVFSCSVMHEALHNHYTQKSLSLSPGK;
or a light chain immunoglobulin variable domain
comprising the amino acid sequence:
DIVMTQTPLSLSVTPGQPASISCKASQSLDYEGDSDMNWYLQKPGQPPQL

LIYGASNLESGVPDRFSGSGSGTDFTLKISRVEAEDVGVYYCQQSTEDPR

TFGGGTKVEIK (amino acids 21-131 of SEQ ID NO: 126
(CDRs underscored));
and a heavy chain immunoglobulin variable domain
comprising the amino acid sequence:
QMQLVQSGPEVKKPGTSVKVSCKASGYTFTDYNVDWVRQARGQRLEWIGDI

NPNNGGTIYAQKFQERVTITVDKSTSTAYMELSSLRSEDTAVYYCARNYRW

FGAMDHWGQGTTVTVSS (amino acids 1-119 of SEQ ID

NO: 106 (CDRs underscored)); or comprising the
CDRs:

CDR-L1:
                              (SEQ ID NO: 38)
KASQSLDYEGDSDMN;

CDR-L2:
                              (SEQ ID NO: 39)
GASNLES;

CDR-L3:
                              (SEQ ID NO: 40)
QQSTEDPRT;

CDR-H1:
                              (SEQ ID NO: 33)
DYNVD;

CDR-H2:
                              (SEQ ID NO: 458)
DINPNNGGTIYAQKFQE;
and

CDR-H3:
                              (SEQ ID NO: 35)
NYRWFGAMDH
```

Ab2: humanized light chain 45AGX Humanizedx [LAG3_H] mAb (LB145.22D2.E1.D1 (VL3)) Kappa (PX) (or the variable domain thereof) and humanized heavy chain 56AHH Humanizedx[LAG3_H] mAb (LB145.22D2.E1.D1 VH6 N55S) IgG1/Kappa (PX) (or the variable domain thereof); for example: comprising:

```
a light chain immunoglobulin comprising the amino
acid sequence:
DIVMTQTPLSLSVTPGQPASISCKASQSLDYEGDSDMNWYLQKPGQPPQL

LIYGASNLESGVPDRFSGSGSGTDFTLKISRVEAEDVGVYYCQQSTEDPR

TFGGGTKVEIKRTVAAPSVFIFPPSDEQLKSGTASVVCLLNNFYPREAKV
```

QWKVDNALQSGNSQESVTEQDSKDSTYSLSSTLTLSKADYEKHKVYACEV

THQGLSSPVTKSFNRGEC(amino acids 21-238 of SEQ ID
NO: 126);
and a heavy chain immunoglobulin comprising the amino
acid sequence:
(SEQ ID NO: 108)
QMQLVQSGPEVKKPGTSVKVSCKASGYTFTDYNVDWVRQARGQRLEWIGD

INPNNGGTIYAQKFQERVTITVDKSTSTAYMELSSLRSEDTAVYYCARNY

RWFGAMDHWGQGTTVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKKVEPKSCDKTHTCPPCPAPELLGGPSVFLFPPKPK

DTLMISRTPEVTCVVVDVSHEDPEVKFNWYVDGVEVHNAKTKPREEQYNS

TYRVVSVLTVLHQDWLNGKEYKCKVSNKALPAPIEKTISKAKGQPREPQV

YTLPPSRDELTKNQVSLTCLVKGFYPSDIAVEWESNGQPENNYKTTPPVL

DSDGSFFLYSKLTVDKSRWQQGNVFSCSVMHEALHNHYTQKSLSLSPGK;
or a light chain immunoglobulin variable domain
comprising the amino acid sequence:
DIVMTQTPLSLSVTPGQPASISCKASQSLDYEGDSDMNWYLQKPGQPPQL

LIYGASNLESGVPDRFSGSGSGTDFTLKISRVEAEDVGVYYCQQSTEDPR

TFGGGTKVEIK (amino acids 21-131 of SEQ ID NO: 126
(CDRs underscored));
and a heavy chain immunoglobulin variable domain
comprising the amino acid sequence:
QMQLVQSGPEVKKPGTSVKVSCKASGYTFTDYNVDWVRQARGQRLEWIGDI

NPNNGGTIYAQKFQERVTITVDKSTSTAYMELSSLRSEDTAVYYCARNYRW

FGAMDHWGQGTTVTVSS (amino acids 1-119 of SEQ ID

NO: 106 (CDRs underscored)); or comprising the
CDRs:

CDR-L1:
(SEQ ID NO: 38)
KASQSLDYEGDSDMN;

CDR-L2:
(SEQ ID NO: 39)
GASNLES;

CDR-L3:
(SEQ ID NO: 40)
QQSTEDPRT;

CDR-H1:
(SEQ ID NO: 33)
DYNVD;

CDR-H2:
(SEQ ID NO: 456)
DINPNNGGTIYAQKFQE;
and

CDR-H3:
(SEQ ID NO: 35)
NYRWFGAMDH

Ab3: humanized light chain 45AGX Humanized×[LAG3_H] mAb (LB145.22D2.E1.D1 (VL3)) Kappa (PX) (or the variable domain thereof) and humanized heavy chain 54AHH Humanized×[LAG3_H] mAb (LB145.22D2.E1.D1 VH6 N55D) IgG1/Kappa (PX) (or the variable domain thereof); for example comprising:

a light chain immunoglobulin comprising the amino
acid sequence:
DIVMTQTPLSLSVTPGQPASISCKASQSLDYEGDSDMNWYLQKPGQPPQL

LIYGASNLESGVPDRFSGSGSGTDFTLKISRVEAEDVGVYYCQQSTEDPR

TFGGGTKVEIKRTVAAPSVFIFPPSDEQLKSGTASVVCLLNNFYPREAKV

QWKVDNALQSGNSQESVTEQDSKDSTYSLSSTLTLSKADYEKHKVYACEV

THQGLSSPVTKSFNRGEC(amino acids 21-238 of SEQ ID
NO: 126);
and a heavy chain immunoglobulin comprising the amino
acid sequence:
(SEQ ID NO: 110)
QMQLVQSGPEVKKPGTSVKVSCKASGYTFTDYNVDWVRQARGQRLEWIGD

INPNNGGTIYAQKFQERVTITVDKSTSTAYMELSSLRSEDTAVYYCARNY

RWFGAMDHWGQGTTVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKKVEPKSCDKTHTCPPCPAPELLGGPSVFLFPPKPK

DTLMISRTPEVTCVVVDVSHEDPEVKFNWYVDGVEVHNAKTKPREEQYNS

TYRVVSVLTVLHQDWLNGKEYKCKVSNKALPAPIEKTISKAKGQPREPQV

YTLPPSRDELTKNQVSLTCLVKGFYPSDIAVEWESNGQPENNYKTTPPVL

DSDGSFFLYSKLTVDKSRWQQGNVFSCSVMHEALHNHYTQKSLSLSPGK;
or a light chain immunoglobulin variable domain
comprising the amino acid sequence:
DIVMTQTPLSLSVTPGQPASISCKASQSLDYEGDSDMNWYLQKPGQPPQL

LIYGASNLESGVPDRFSGSGSGTDFTLKISRVEAEDVGVYYCQQSTEDPR

TFGGGTKVEIK (amino acids 21-131 of SEQ ID NO: 126
(CDRs underscored));
and a heavy chain immunoglobulin variable domain
comprising the amino acid sequence:
QMQLVQSGPEVKKPGTSVKVSCKASGYTFTDYNVDWVRQARGQRLEWIGDI

NPNNGGTIYAQKFQERVTITVDKSTSTAYMELSSLRSEDTAVYYCARNYRW

FGAMDHWGQGTTVTVSS (amino acids 1-119 of SEQ ID
NO: 110 (CDRs underscored)); or comprising the
CDRs:

CDR-L1:
(SEQ ID NO: 38)
KASQSLDYEGDSDMN;

CDR-L2:
(SEQ ID NO: 39)
GASNLES;

CDR-L3:
(SEQ ID NO: 40)
QQSTEDPRT;

CDR-H1:
(SEQ ID NO: 33)
DYNVD;

CDR-H2:
(SEQ ID NO: 457)
DINPNNGGTIYAQKFQE;
and

-continued

CDR-H3:
(SEQ ID NO: 35)
NYRWFGAMDH

Ab4: humanized light chain 45AGX Humanizedx [LAG3_H] mAb (LB145.22D2.E1.D1 (VL3)) Kappa (PX) (or the variable domain thereof) and humanized heavy chain 52AHH Humanizedx[LAG3_H] mAb (LB145.22D2.E1.D1 VH6 N55Q) IgG1/Kappa (PX) (or the variable domain thereof); for example comprising:

```
a light chain immunoglobulin comprising the amino
acid sequence:
DIVMTQTPLSLSVTPGQPASISCKASQSLDYEGDSDMNWYLQKPGQPPQL

LIYGASNLESGVPDRFSGSGSGTDFTLKISRVEAEDVGVYYCQQSTEDPR

TFGGGTKVEIKRTVAAPSVFIFPPSDEQLKSGTASVVCLLNNFYPREAKV

QWKVDNALQSGNSQESVTEQDSKDSTYSLSSTLTLSKADYEKHKVYACEV

THQGLSSPVTKSFNRGEC(amino acids 21-238 of SEQ ID
NO: 126);
and a heavy chain immunoglobulin comprising the amino
acid sequence:
                                    (SEQ ID NO: 112)
QMQLVQSGPEVKKPGTSVKVSCKASGYTFTDYNVDWVRQARGQRLEWIGD

INPNNGGTIYAQKFQERVTITVDKSTSTAYMELSSLRSEDTAVYYCARNY

RWFGAMDHWGQGTTVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKKVEPKSCDKTHTCPPCPAPELLGGPSVFLFPPKPK

DTLMISRTPEVTCVVVDVSHEDPEVKFNWYVDGVEVHNAKTKPREEQYNS

TYRVVSVLTVLHQDWLNGKEYKCKVSNKALPAPIEKTISKAKGQPREPQV

YTLPPSRDELTKNQVSLTCLVKGFYPSDIAVEWESNGQPENNYKTTPPVL

DSDGSFFLYSKLTVDKSRWQQGNVFSCSVMHEALHNHYTQKSLSLSPGK;
or a light chain immunoglobulin variable domain
comprising the amino acid sequence:
DIVMTQTPLSLSVTPGQPASISCKASQSLDYEGDSDMNWYLQKPGQPPQL

LIYGASNLESGVPDRFSGSGSGTDFTLKISRVEAEDVGVYYCQQSTEDPR

TFGGGTKVEIK (amino acids 21-131 of SEQ ID NO: 126
(CDRs underscored));
and a heavy chain immunoglobulin variable domain
comprising the amino acid sequence:
QMQLVQSGPEVKKPGTSVKVSCKASGYTFTDYNVDWVRQARGQRLEWIGDI

NPNNGGTIYAQKFQERVTITVDKSTSTAYMELSSLRSEDTAVYYCARNYRW

FGAMDHWGQGTTVTVSS (amino acids 1-119 of SEQ ID
NO: 112 (CDRs underscored)); or comprising the
CDRs:

CDR-L1:
                                    (SEQ ID NO: 38)
KASQSLDYEGDSDMN;

CDR-L2:
                                    (SEQ ID NO: 39)
GASNLES;

CDR-L3:
                                    (SEQ ID NO: 40)
```

-continued
```
QQSTEDPRT;

CDR-H1:
                                    (SEQ ID NO: 33)
DYNVD;

CDR-H2:
                                    (SEQ ID NO: 455)
DINPNNGGTIYAQKFQE;
and

CDR-H3:
                                    (SEQ ID NO: 35)
NYRWFGAMDH
```

Ab5: humanized light chain 45AGX Humanizedx [LAG3_H] mAb (LB145.22D2.E1.D1 (VL3)) Kappa (PX) (or the variable domain thereof) and humanized heavy chain 57AHH Humanizedx[LAG3_H] mAb (LB145.22D2.E1.D1 VH6) IgG4 S228P (PX) (or the variable domain thereof); for example comprising:

```
a light chain immunoglobulin comprising the amino
acid sequence:
DIVMTQTPLSLSVTPGQPASISCKASQSLDYEGDSDMNWYLQKPGQPPQL

LIYGASNLESGVPDRFSGSGSGTDFTLKISRVEAEDVGVYYCQQSTEDPR

TFGGGTKVEIKRTVAAPSVFIFPPSDEQLKSGTASVVCLLNNFYPREAKV

QWKVDNALQSGNSQESVTEQDSKDSTYSLSSTLTLSKADYEKHKVYACEV

THQGLSSPVTKSFNRGEC(amino acids 21-238 of SEQ ID
NO: 126);
and a heavy chain immunoglobulin comprising the amino
acid sequence:
                                    (SEQ ID NO: 114)
QMQLVQSGPEVKKPGTSVKVSCKASGYTFTDYNVDWVRQARGQRLEWIGD

INPNNGGTIYAQKFQERVTITVDKSTSTAYMELSSLRSEDTAVYYCARNY

RWFGAMDHWGQGTTVTVSSASTKGPSVFPLAPSSKSTSGGTAALGCLVKD

YFPEPVTVSWNSGALTSGVHTFPAVLQSSGLYSLSSVVTVPSSSLGTQTY

ICNVNHKPSNTKVDKKVEPKSCDKTHTCPPCPAPELLGGPSVFLFPPKPK

DTLMISRTPEVTCVVVDVSHEDPEVKFNWYVDGVEVHNAKTKPREEQYNS

TYRVVSVLTVLHQDWLNGKEYKCKVSNKALPAPIEKTISKAKGQPREPQV

YTLPPSRDELTKNQVSLTCLVKGFYPSDIAVEWESNGQPENNYKTTPPVL

DSDGSFFLYSKLTVDKSRWQQGNVFSCSVMHEALHNHYTQKSLSLSPGK;
or a light chain immunoglobulin variable domain
comprising the amino acid sequence:
DIVMTQTPLSLSVTPGQPASISCKASQSLDYEGDSDMNWYLQKPGQPPQL

LIYGASNLESGVPDRFSGSGSGTDFTLKISRVEAEDVGVYYCQQSTEDPR

TFGGGTKVEIK (amino acids 21-131 of SEQ ID NO: 126
(CDRs underscored));
and a heavy chain immunoglobulin variable domain
comprising the amino acid sequence:
QMQLVQSGPEVKKPGTSVKVSCKASGYTFTDYNVDWVRQARGQRLEWIGDI

NPNNGGTIYAQKFQERVTITVDKSTSTAYMELSSLRSEDTAVYYCARNYRW

FGAMDHWGQGTTVTVSS (amino acids 1-119 of SEQ ID
NO: 114 (CDRs underscored)); or comprising the
CDRs:
```

CDR-L1:
(SEQ ID NO: 38)
KASQSLDYEGDSDMN;

CDR-L2:
(SEQ ID NO: 39)
GASNLES;

CDR-L3:
(SEQ ID NO: 40)
QQSTEDPRT;

CDR-H1:
(SEQ ID NO: 33)
DYNVD;

CDR-H2:
(SEQ ID NO: 458)
DINPNNGGTIYAQKFQE;
and

CDR-H3:
(SEQ ID NO: 35)
NYRWFGAMDH

Ab6: humanized light chain 45AGX Humanizedx [LAG3_H] mAb (LB145.22D2.E1.D1 (VL3)) Kappa (PX) (or the variable domain thereof) and humanized heavy chain 73AHD Humanizedx[LAG3_H] mAb (LB145.22D2.E1.D1 VH6 N55D/VL3) IgG4 S228P/Kappa (PX) (or the variable domain thereof); for example comprising:

a light chain immunoglobulin comprising the amino acid sequence:
DIVMTQTPLSLSVTPGQPASISCKASQSLDYEGDSDMNWYLQKPGQPPQL
LIYGASNLESGVPDRFSGSGSGTDFTLKISRVEAEDVGVYYCQQSTEDPR
TFGGGTKVEIKRTVAAPSVFIFPPSDEQLKSGTASVVCLLNNFYPREAKV
QWKVDNALQSGNSQESVTEQDSKDSTYSLSSTLTLSKADYEKHKVYACEV
THQGLSSPVTKSFNRGEC (amino acids 21-238 of SEQ ID NO: 126);
and a heavy chain immunoglobulin comprising the amino acid sequence:
(SEQ ID NO: 116)
QMQLVQSGPEVKKPGTSVKVSCKASGYTFTDYNVDWVRQARGQRLEWIGD
INPNNGGTIYAQKFQERVTITVDKSTSTAYMELSSLRSEDTAVYYCARNY
RWFGAMDHWGQGTTVTVSSASTKGPSVFPLAPSSKSTSGGTAALGCLVKD
YFPEPVTVSWNSGALTSGVHTFPAVLQSSGLYSLSSVVTVPSSSLGTQTY
ICNVNHKPSNTKVDKKVEPKSCDKTHTCPPCPAPELLGGPSVFLFPPKPK
DTLMISRTPEVTCVVVDVSHEDPEVKFNWYVDGVEVHNAKTKPREEQYNS
TYRVVSVLTVLHQDWLNGKEYKCKVSNKALPAPIEKTISKAKGQPREPQV
YTLPPSRDELTKNQVSLTCLVKGFYPSDIAVEWESNGQPENNYKTTPPVL
DSDGSFFLYSKLTVDKSRWQQGNVFSCSVMHEALHNHYTQKSLSLSPGK;
or a light chain immunoglobulin variable domain comprising the amino acid sequence:
DIVMTQTPLSLSVTPGQPASISCKASQSLDYEGDSDMNWYLQKPGQPPQL
LIYGASNLESGVPDRFSGSGSGTDFTLKISRVEAEDVGVYYCQQSTEDPR TFGGGTKVEIK (amino acids 21-131 of SEQ ID NO: 126 (CDRs underscored));
and a heavy chain immunoglobulin variable domain comprising the amino acid sequence:
QMQLVQSGPEVKKPGTSVKVSCKASGYTFTDYNVDWVRQARGQRLEWIGDI
NPNNGGTIYAQKFQERVTITVDKSTSTAYMELSSLRSEDTAVYYCARNYRW
FGAMDHWGQGTTVTVSS (amino acids 1-119 of SEQ ID NO: 116 (CDRs underscored)); or comprising the CDRs:

CDR-L1:
(SEQ ID NO: 38)
KASQSLDYEGDSDMN;

CDR-L2:
(SEQ ID NO: 39)
GASNLES;

CDR-L3:
(SEQ ID NO: 40)
QQSTEDPRT;

CDR-H1:
(SEQ ID NO: 33)
DYNVD;

CDR-H2:
(SEQ ID NO: 457)
DINPNNGGTIYAQKFQE;
and

CDR-H3:
(SEQ ID NO: 35)
NYRWFGAMDH

Ab7: humanized light chain 45AGX Humanizedx [LAG3_H] mAb (LB145.22D2.E1.D1 (VL3)) Kappa (PX) (or the variable domain thereof) and humanized heavy chain 21AHG Humanizedx[LAG3_H] mAb (LB145.22D2.E1.D1 VH6 N55S/VL3) IgG4 S228P/Kappa (PX) (or the variable domain thereof); for example comprising:

a light chain immunoglobulin comprising the amino acid sequence:
DIVMTQTPLSLSVTPGQPASISCKASQSLDYEGDSDMNWYLQKPGQPPQL
LIYGASNLESGVPDRFSGSGSGTDFTLKISRVEAEDVGVYYCQQSTEDPR
TFGGGTKVEIKRTVAAPSVFIFPPSDEQLKSGTASVVCLLNNFYPREAKV
QWKVDNALQSGNSQESVTEQDSKDSTYSLSSTLTLSKADYEKHKVYACEV
THQGLSSPVTKSFNRGEC (amino acids 21-238 of SEQ ID NO: 126);
and a heavy chain immunoglobulin comprising the amino acid sequence:
(SEQ ID NO: 118)
QMQLVQSGPEVKKPGTSVKVSCKASGYTFTDYNVDWVRQARGQRLEWIGD
INPNNGGTIYAQKFQERVTITVDKSTSTAYMELSSLRSEDTAVYYCARNY
RWFGAMDHWGQGTTVTVSSASTKGPSVFPLAPSSKSTSGGTAALGCLVKD
YFPEPVTVSWNSGALTSGVHTFPAVLQSSGLYSLSSVVTVPSSSLGTQTY
ICNVNHKPSNTKVDKKVEPKSCDKTHTCPPCPAPELLGGPSVFLFPPKPK
DTLMISRTPEVTCVVVDVSHEDPEVKFNWYVDGVEVHNAKTKPREEQYNS
TYRVVSVLTVLHQDWLNGKEYKCKVSNKALPAPIEKTISKAKGQPREPQV -continued
YTLPPSRDELTKNQVSLTCLVKGFYPSDIAVEWESNGQPENNYKTTPPVL DSDGSFFLYSKLTVDKSRWQQGNVFSCSVMHEALHNHYTQKSLSLSPGK;
or a light chain immunoglobulin variable domain
comprising the amino acid sequence:
DIVMTQTPLSLSVTPGQPASISC<u>KASQSLDYEGDSDMN</u>WYLQKPGQPPQL LIY<u>GASNLES</u>GVPDRFSGSGSGTDFTLKISRVEAEDVGVYYC<u>QQSTEDPR</u>

<u>T</u>FGGGTKVEIK (amino acids 21-131 of SEQ ID NO: 126
(CDRs underscored));
and a heavy chain immunoglobulin variable domain
comprising the amino acid sequence:
QMQLVQSGPEVKKPGTSVKVSCKASGYTFT<u>DYNVD</u>WVRQARGQRLEWIG<u>DI</u>

<u>NPNNGGTIYAQKF</u>QERVTITVDKSTSTAYMELSSLRSEDTAVYYCAR<u>NYRW</u>

<u>FGAMDH</u>WGQGTTVTVSS (amino acids 1-119 of SEQ ID
NO: 106 (CDRs underscored)); or comprising the
CDRs:

CDR-L1:
(SEQ ID NO: 38)
KASQSLDYEGDSDMN;

CDR-L2:
(SEQ ID NO: 39)
GASNLES;

CDR-L3:
(SEQ ID NO: 40)
QQSTEDPRT;

CDR-H1:
(SEQ ID NO: 33)
DYNVD;

CDR-H2:
(SEQ ID NO: 456)
DINPNNGGTIYAQKFQE;
and

CDR-H3:
(SEQ ID NO: 35)
NYRWFGAMDH

Ab8: humanized light chain 45AGX Humanized×[LAG3_H] mAb (LB145.22D2.E1.D1 (VL3)) Kappa (PX) (or the variable domain thereof) and humanized heavy chain 80AHG Humanized×[LAG3_H] mAb (LB145.22D2.E1.D1 VH6 N55Q/VL3) IgG4 S228P/Kappa (PX) (or the variable domain thereof); for example comprising:

a light chain immunoglobulin comprising the amino
acid sequence:
DIVMTQTPLSLSVTPGQPASISCKASQSLDYEGDSDMNWYLQKPGQPPQL

LIYGASNLESGVPDRFSGSGSGTDFTLKISRVEAEDVGVYYCQQSTEDPR

TFGGGTKVEIKRTVAAPSVFIFPPSDEQLKSGTASVVCLLNNFYPREAKV

QWKVDNALQSGNSQESVTEQDSKDSTYSLSSTLTLSKADYEKHKVYACEV

THQGLSSPVTKSFNRGEC (amino acids 21-238 of SEQ ID

NO: 126);
and a heavy chain immunoglobulin comprising the amino
acid sequence:
QMQLVQSGPEVKKPGTSVKVSCKASGYTFTDYNVDWVRQARGQRLEWIGD

INPNQGGTIYAQKFQERVTITVDKSTSTAYMELSSLRSEDTAVYYCARNY

RWFGAMDHWGQGTTVTVSSASTKGPSVFPLAPCSRSTSESTAALGCLVKD

YFPEPVTVSWNSGALTSGVHTFPAVLQSSGLYSLSSVVTVPSSSLGTKTY

TCNVDHKPSNTKVDKRVESKYGPPCPPCPAPEFLGGPSVFLFPPKPKDTL

MISRTPEVTCVVVDVSQEDPEVQFNWYVDGVEVHNAKTKPREEQFNSTYR

VVSVLTVLHQDWLNGKEYKCKVSNKGLPSSIEKTISKAKGQPREPQVYTL

PPSQEEMTKNQVSLTCLVKGFYPSDIAVEWESNGQPENNYKTTPPVLDSD

GSFFLYSRLTVDKSRWQEGNVFSCSVMHEALHNHYTQKSLSLSLGK (SEQ ID NO: 120);
or a light chain immunoglobulin variable domain
comprising the amino acid sequence:
DIVMTQTPLSLSVTPGQPASISC<u>KASQSLDYEGDSDMN</u>WYLQKPGQPPQL LIY<u>GASNLES</u>GVPDRFSGSGSGTDFTLKISRVEAEDVGVYYC<u>QQSTEDPR</u>

<u>T</u>FGGGTKVEIK (amino acids 21-131 of SEQ ID NO: 126

(CDRs underscored));
and a heavy chain immunoglobulin variable domain
comprising the amino acid sequence:
QMQLVQSGPEVKKPGTSVKVSCKASGYTFT<u>DYNVD</u>WVRQARGQRLEWIG<u>D</u>

<u>INPNQGGTIYAQKF</u>QERVTITVDKSTSTAYMELSSLRSEDTAVYYCAR<u>NY</u>

<u>RWFGAMDH</u>WGQGTTVTVSS (amino acids 1-119 of SEQ ID

NO: 120 (CDRs underscored));
or comprising the CDRs:
CDR-L1:
KASQSLDYEGDSDMN (SEQ ID NO: 38);

CDR-L2:
GASNLES (SEQ ID NO: 39);

CDR-L3:
QQSTEDPRT (SEQ ID NO: 40);

CDR-H1:
DYNVD (SEQ ID NO: 33);

CDR-H2:
DINPNQGGTIYAQKFQE (SEQ ID NO: 455);
and

CDR-H3:
NYRWFGAMDH (SEQ ID NO: 35)

or

Ab9: humanized light chain 45AGX Humanized×[LAG3_H] mAb (LB145.22D2.E1.D1 (VL3)) Kappa (PX) (or the variable domain thereof) and humanized heavy chain 72AHD Humanized×[LAG3_H] mAb (LB145.22D2.E1.D1 VH6 N55G/VL3) IgG4 S228P/Kappa (PX)) (or the variable domain thereof); for example comprising:

a light chain immunoglobulin comprising the amino
acid sequence:
DIVMTQTPLSLSVTPGQPASISCKASQSLDYEGDSDMNWYLQKPGQPPQL

LIYGASNLESGVPDRFSGSGSGTDFTLKISRVEAEDVGVYYCQQSTEDPR

TFGGGTKVEIKRTVAAPSVFIFPPSDEQLKSGTASVVCLLNNFYPREAKV

```
-continued
QWKVDNALQSGNSQESVTEQDSKDSTYSLSSTLTLSKADYEKHKVYACEV

THQGLSSPVTKSFNRGEC (amino acids 21-238 of SEQ ID

NO: 126);
and a heavy chain immunoglobulin comprising the amino
acid sequence:
QMQLVQSGPEVKKPGTSVKVSCKASGYTFTDYNVDWVRQARGQRLEWIGD

INPNGGGTIYAQKFQERVTITVDKSTSTAYMELSSLRSEDTAVYYCARNY

RWFGAMDHWGQGTTVTVSSASTKGPSVFPLAPCSRSTSESTAALGCLVKD

YFPEPVTVSWNSGALTSGVHTFPAVLQSSGLYSLSSVVTVPSSSLGTKTY

TCNVDHKPSNTKVDKRVESKYGPPCPPCPAPEFLGGPSVFLFPPKPKDTL

MISRTPEVTCVVVDVSQEDPEVQFNWYVDGVEVHNAKTKPREEQFNSTYR

VVSVLTVLHQDWLNGKEYKCKVSNKGLPSSIEKTISKAKGQPREPQVYTL

PPSQEEMTKNQVSLTCLVKGFYPSDIAVEWESNGQPENNYKTTPPVLDSD

GSFFLYSRLTVDKSRWQEGNVFSCSVMHEALHNHYTQKSLSLSLGK (SEQ ID NO: 122);
or a light chain immunoglobulin variable domain
comprising the amino acid sequence:
DIVMTQTPLSLSVTPGQPASISCKASQSLDYEGDSDMNWYLQKPGQPPQL

LIYGASNLESGVPDRFSGSGSGTDFTLKISRVEAEDVGVYYCQQSTEDPR

TFGGGTKVEIK (amino acids 21-131 of SEQ ID NO: 126

(CDRs underscored));
and a heavy chain immunoglobulin variable domain
comprising the amino acid sequence:
QMQLVQSGPEVKKPGTSVKVSCKASGYTFTDYNVDWVRQARGQRLEWIGD

INPNGGGTIYAQKFQERVTITVDKSTSTAYMELSSLRSEDTAVYYCARNY

RWFGAMDHWGQGTTVTVSS (amino acids 1-119 of SEQ ID

NO: 122 (CDRs underscored));
or comprising the CDRs:
CDR-L1:
KASQSLDYEGDSDMN (SEQ ID NO: 38);

CDR-L2:
GASNLES (SEQ ID NO: 39);

CDR-L3:
QQSTEDPRT (SEQ ID NO: 40);

CDR-H1:
DYNVD (SEQ ID NO: 33);

CDR-H2:
DINPNGGGTIYAQKFQE (SEQ ID NO: 454);
and

CDR-H3:
NYRWFGAMDH (SEQ ID NO: 35)
```

In an embodiment of the invention, the CDR-H2 of any anti-LAG3 antibody or antigen-binding fragment thereof of the present invention comprises the amino acid sequence:

DINPNX$_1$GGTIYX$_2$QKFX$_3$X$_4$ (SEQ ID NO: 446)

wherein,
X$_1$=D, N, S or Q
X$_2$=A or S
X$_3$=Q or K
X$_4$=E or G

Humanized heavy immunoglobulin chains are set forth in SEQ ID NOs: 106, 108, 110, 112, 114, 116, 118, 120, 122, 124, 124, 128, 134, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 212, 214, 216, 218, 220, 222, 234, 235, 237, 239, 243, 245, 247, 249, 251, 253, 255, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 353, 355, 357, 359, 361, 363, 365, 367, 377, 379, 381, 383, 385, 387, 389, 391, 393, 395, 397, 399, 406-419, 448, 449, 462 and 463. DNA encoding humanized heavy immunoglobulin chains are set forth in SEQ ID NOs: 105, 107, 109, 111, 113, 115, 117, 119, 121, 123, 127, 133, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 211, 213, 215, 217, 219, 221, 233, 236, 238, 242, 244, 246, 248, 250, 252, 254, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 352, 354, 356, 358, 360, 362, 364, 366, 376, 378, 380, 382, 384, 386, 388, 390, 392, 394, 396 and 398.

Humanized light immunoglobulin chains are set forth in SEQ ID NOs: 126, 130, 132, 136, 138, 208, 210, 224, 226, 228, 230, 232, 241, 257, 259, 261, 263, 351, 369, 371, 373, 375, 401, 403, 405, 450-453, 426, 427 and 459-461. DNA encoding humanized light immunoglobulin chains are set forth in SEQ ID NOs: 125, 129, 131, 135, 137, 207, 209, 223, 225, 227, 229, 231, 240, 256, 258, 260, 262, 350, 368, 370, 372, 374, 400, 402 and 404.

A "variant" of a polypeptide, such as an immunoglobulin chain, refers to a polypeptide comprising an amino acid sequence that is at least about 70-99.9% (e.g., 70, 72, 74, 75, 76, 79, 80, 81, 82, 83, 84, 85, 86, 87, 88, 89, 90, 91, 92, 93, 94, 95, 96, 97, 98, 99, 99.5, 99.9%) identical or similar to a referenced amino acid sequence that is set forth herein; when the comparison is performed by a BLAST algorithm wherein the parameters of the algorithm are selected to give the largest match between the respective sequences over the entire length of the respective reference sequences (e.g., expect threshold: 10; word size: 3; max matches in a query range: 0; BLOSUM 62 matrix; gap costs: existence 11, extension 1; conditional compositional score matrix adjustment).

A "variant" of a polynucleotide refers to a polynucleotide comprising a nucleotide sequence that is at least about 70-99.9% (e.g., 70, 72, 74, 75, 76, 79, 80, 81, 82, 83, 84, 85, 86, 87, 88, 89, 90, 91, 92, 93, 94, 95, 96, 97, 98, 99, 99.5, 99.9%) identical to a referenced nucleotide sequence that is set forth herein; when the comparison is performed by a BLAST algorithm wherein the parameters of the algorithm are selected to give the largest match between the respective sequences over the entire length of the respective reference sequences (e.g., expect threshold: 10; word size: 28; max matches in a query range: 0; match/mismatch scores: 1, −2; gap costs: linear).

Polypeptides and anti-LAG3 antibodies and antigen-binding fragments thereof (e.g., humanized antibodies) of the present invention, in an embodiment of the invention, include a heavy chain immunoglobulin variable region having at least 78.99% (e.g., 79%, 80%, 85%, 90%, 95%, 99%) amino acid sequence identity to amino acids 1-119 of SEQ ID NO: 106; and/or a light chain immunoglobulin variable region having at least 78.38% (e.g., 79%, 80%, 85%, 90%, 95%, 99%) amino acid sequence identity to amino acids 1-111 of SEQ ID NO: 224.

In addition, a variant may be a polypeptide comprising an amino acid sequence that is set forth herein except for one or more (e.g., 1, 2, 3, 4, 5, 6, 7, 8, 9 or 10) mutations such as, for example, missense mutations (e.g., conservative substitutions), non-sense mutations, deletions, or insertions. Such a polypeptide may be an immunoglobulin light chain, an immunoglobulin heavy chain and/or a CDR (e.g., any one or more of CDR-L1, CDR-L2, CDR-L3, CDR-H1, CDR-H2 and/or CDR-H3).

As discussed herein, the present invention includes anti-LAG3 antibodies and antigen-binding fragments thereof that include one or more variants of the framework sequences (e.g., any one or more of FR-L1, FR-L2, FR-L3, FR-L4, FR-H1, FR-H2, FR-H3 and/or FR-H4), CDRs (e.g., 1, 2 or 3 variant CDR-Ls and/or 1, 2, or 3 variant CDR-Hs) and/or immunoglobulin chains (e.g., 1 or 2 variant $V_L$s and/or 1 or 2 variant $V_H$s) whose sequences are specifically set forth herein. Such antibodies and antigen-binding fragments may, themselves, be referred to as variants. Simple polypeptide chains, that include one or more variant FRs, CDR-Ls, CDR-Hs and/or immunoglobulin chains, themselves are also part of the present invention. Polynucleotides encoding such variant polypeptide chains are also part of the present invention. For example, the present invention provides anti-LAG3 antibodies and antigen-binding fragments thereof that comprising the amino acid sequence of the $V_H$ and $V_L$ of the antibodies Ab1, Ab2, Ab3, Ab4, Ab5, Ab6, Ab7, Ab8 or Ab9, which are set forth herein, as well as variants thereof comprising the CDR-L1, CDR-L2, CDR-L3, CDR-H1, CDR-H2 and CDR-H3 of said Ab1, Ab2, Ab3, Ab4, Ab5, Ab6, Ab7, Ab8 or Ab9 but comprising 70% or more (e.g., 80%, 85%, 90%, 95%, 97% or 99%) overall amino acid sequence identity or similarity to said $V_H$ and $V_L$ of Ab1, Ab2, Ab3, Ab4, Ab5, Ab6, Ab7, Ab8 or Ab9. Thus, in such embodiments, the CDRs of the antibodies and fragments are identical to those of the $V_H$ and $V_L$ of Ab1, Ab2, Ab3, Ab4, Ab5, Ab6, Ab7, Ab8 or Ab9 but any differences from such $V_H$ and $V_L$ occur in the frameworks and/or immunoglobulin constant domains.

The invention provides variant anti-LAG3 antibodies or antigen-binding fragments thereof (e.g., humanized antibodies such as antagonist humanized antibodies) comprising one or more variant CDRs (e.g., any one or more of CDR-L1, CDR-L2, CDR-L3, CDR-H1, CDR-H2 and/or CDR-H3) and/or framework regions (e.g., any one or more of FR1, FR2, FR3 and/or FR4) that are set forth herein; and/or one or more variant $V_L$ domains and/or one or more variant $V_H$ domains of such antibodies or fragments that are set forth herein, for example, with at least 70%, 75%, 80%, 85%, 90%, 95%, 98%, 99% or 99.9% sequence identity or similarity to, e.g., SEQ ID NO: 2, 3, 4, 5, 7, 8, 9, 10, 12, 13, 14, 15, 17, 18, 19, 20, 22, 23, 24, 25, 27, 28, 29, 30, 32, 33, 34, 35, 37, 38, 39, 40, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 406, 407, 408, 409, 410, 411, 412, 413, 414, 415, 416, 417, 418, 419, 426, 427, 434, 435, 436, 437, 438, 439, 440, 441, 442, 446, 448, 449, 451, 452, 453, 454, 455, 456, 457, 458, 459, 460, 461, 462, 463 or 464; which specifically bind to LAG3.

As discussed above, the scope of the present invention includes variant anti-LAG3 antibodies or antigen-binding fragments comprising one or more variant CDRs (e.g., 1, 2 or 3 variant CDR-Ls and/or 1, 2, or 3 variant CDR-H); and/or framework regions (e.g., any one or more of FR1, FR2, FR3 and/or FR4) and/or variant $V_L$ and/or variant $V_H$ domains (with or without a signal sequence) having 1, 2, 3, 4, 5, 6, 7, 8, 9, 10 or more mutations. The mutations can include point mutations which are conservative or non-conservative amino acid substitutions or point deletions, for example in a framework region and/or in a CDR. As discussed above, the present invention provides anti-LAG3 antibodies and antigen binding fragments thereof comprising CDR-L1, CDR-L2, CDR-L3, CDR-H1, CDR-H2 and CDR-H3 of Ab1, Ab2, Ab3, Ab4, Ab5, Ab6, Ab7, Ab8 or Ab9 but having mutations in the framework regions thereof.

Conservatively modified variant anti-LAG3 antibodies and antigen-binding fragments thereof are also part of the present invention. A "conservatively modified variant" or a "conservative substitution" refers to a variant wherein there is one or more substitutions of amino acids in a polypeptide with other amino acids having similar characteristics (e.g. charge, side-chain size, hydrophobicity/hydrophilicity, backbone conformation and rigidity, etc.). Such changes can frequently be made without significantly disrupting the biological activity of the antibody or fragment. Those of skill in this art recognize that, in general, single amino acid substitutions in non-essential regions of a polypeptide do not substantially alter biological activity (see, e.g., Watson et al. (1987) *Molecular Biology of the Gene*, The Benjamin/Cummings Pub. Co., p. 224 (4th Ed.)). In addition, substitutions of structurally or functionally similar amino acids are less likely to significantly disrupt biological activity.

Variant anti-LAG3 antibodies or antigen-binding fragments of the present invention, which are discussed herein, comprise one or more CDRs (e.g., 1, 2 or 3 variant CDR-Ls and/or 1, 2, or 3 variant CDR-H); framework regions (e.g., any one or more of FR1, FR2, FR3 and/or FR4); and/or immunoglobulin chains having one or more conservative substitutions. For example, such antibodies and fragments may comprise the amino acid sequences disclosed herein, e.g. SEQ ID NOs: 2, 3, 4, 5, 7, 8, 9, 10, 12, 13, 14, 15, 17, 18, 19, 20, 22, 23, 24, 25, 27, 28, 29, 30, 32, 33, 34, 35, 37, 38, 39, 40, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 406, 407, 408, 409, 410, 411, 412, 413, 414, 415, 416, 417, 418, 419, 426, 427, 434, 435, 436, 437, 438, 439, 440, 441, 442, 446, 448, 449, 451, 452, 453, 454, 455, 456, 457, 458, 459, 460, 461, 462, 463 or 464; wherein such amino acid sequences may comprise 1, 2, 3, 4, 5, 6, 7, 8, 9, 10, 12, 15, 20 or more conservative amino acid substitutions thereof. Exemplary conservative substitutions are set forth in Table 1.

TABLE 1

Exemplary Conservative Amino Acid Substitutions

| Original residue | Conservative substitution |
|---|---|
| Ala (A) | Gly; Ser |
| Arg (R) | Lys; His |
| Asn (N) | Gln; His |
| Asp (D) | Glu; Asn |
| Cys (C) | Ser; Ala |
| Gln (Q) | Asn |
| Glu (E) | Asp; Gln |
| Gly (G) | Ala |
| His (H) | Asn; Gln |
| Ile (I) | Leu; Val |
| Leu (L) | Ile; Val |
| Lys (K) | Arg; His |
| Met (M) | Leu; Ile; Tyr |
| Phe (F) | Tyr; Met; Leu |
| Pro (P) | Ala |
| Ser (S) | Thr |
| Thr (T) | Ser |
| Trp (W) | Tyr; Phe |
| Tyr (Y) | Trp; Phe |
| Val (V) | Ile; Leu |

Function-conservative variants of the anti-LAG3 antibodies and antigen-binding fragments thereof are also part of the present invention. Any of the variants of the anti-LAG3 antibodies and antigen-binding fragments thereof (as discussed herein) may be "function-conservative variants". Such function-conservative variants may, in some cases, also be characterized as conservatively modified variants. "Function-conservative variants," as used herein, refers to variants of the anti-LAG3 antibodies or antigen-binding fragments thereof in which one or more amino acid residues (e.g., of 1, 2, 3, 4, 5 or 6 CDRs and/or of a $V_L$ and/or of a $V_H$) have been changed without significantly altering one or more functional properties of the antibody or fragment. In an embodiment of the invention, a function-conservative variant anti-LAG3 antibody and antigen-binding fragments thereof of the present invention (e.g., humanized antibodies such as antagonist humanized antibodies) comprise a variant of an immunoglobulin chain (e.g., one or two variant $V_H$s and/or one or more variant $V_L$s) and/or of a CDR (e.g., 1, 2 or 3 variant CDR-Ls and/or 1, 2, or 3 variant CDR-H) of any of those set forth herein, e.g., any of SEQ ID NOs: 2, 3, 4, 5, 7, 8, 9, 10, 12, 13, 14, 15, 17, 18, 19, 20, 22, 23, 24, 25, 27, 28, 29, 30, 32, 33, 34, 35, 37, 38, 39, 40, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 406, 407, 408, 409, 410, 411, 412, 413, 414, 415, 416, 417, 418, 419, 426, 427, 434, 435, 436, 437, 438, 439, 440, 441, 442, 446, 448, 449, 451, 452, 453, 454, 455, 456, 457, 458, 459, 460, 461, 462, 463 or 464; exhibiting one or more of the following functional properties:

Inhibits LAG3 binding to MHC class II molecules, e.g., on Daudi cells; for example inhibits human LAG3/MHC class II binding on Daudi cells with an $IC_{50}$ of about 1.9-2.9 nM, e.g., 2.1 nM, 2.8 nM, 2.0 nM, 1.9 nM, 2.5 nM, 2.6 nM, 2.1 nM, 2.4 nM or 2.5 nM. (e.g., about 2.1-2.6 nM).

Competes with MHC class II molecules for LAG3 binding e.g., on Daudi cells;

Binds the extraloop of LAG3;

Binds LAG3 with a $K_D$ of about $10^{-9}$M to about $2\times10^{-12}$M affinity (e.g., as measured by surface plasmon resonance or KinExA); for example binds human LAG3 with a KD of about 2, 3, 6, 10 or 11 pM (e.g., 2-11 pM) and/or binds cynomolgous monkey LAG3 with a KD of about 11, 12, 16 or 25 pM (e.g., 11-25 pM), e.g., by KinExA;

Binds to native LAG3 on the surface of activated CD4+ and/or CD8+ T-cells; for example, binds human CD4+ T-cells expressing human LAG3 with an $EC_{50}$ of about 39, 41 or 57 pM (e.g., about 39-57 pM); binds human CD8+ T-cells expressing human LAG3 with an $EC_{50}$ of about 33, 35 or 49 pM (e.g., about 33-49 pM); binds cynomolgous monkey CD4+ T-cells expressing cynomolgous monkey LAG3 with an $EC_{50}$ of about 27, 30 or 35 pM (e.g., about 27-35 pM); binds cynomolgous monkey CD8+ T-cells expressing cynomolgous monkey LAG3 with an $EC_{50}$ of about 30, 31 or 41 pM (e.g., about 30-41 pM); for example wherein the T-cells are isolated from blood;

Binds to human and/or cynomolgous monkey, e.g., *Macaca fascicularis* or *Macaca mulatta* LAG3;

Inhibits LAG3 homodimerization;

Stimulates antigen-specific T-cell production of IL-2, e.g., IL2 production from the 3A9 murine T-cell hybridoma expressing human LAG3 with an $EC_{50}$ of about 1.06-1.65 nM, 1.74-1.83 nM, 3.56-4.06 nM, 2.83-2.96 nM, 0.57-1.07 nM, 0.45-1.27 nM, 0.47-1.01 nM or 0.72-1.08 nM;

labels tonsil tissue; and/or enhances T-cell activation by anti-PD1 antibody such as pembrolizumab, e.g., increases IL-2 production by T-cells;

does not label brain, heart, kidney, liver, lung, pancreas, and/or pituitary tissue.

binds to human LAG3 by contacting residues QEGAPAQL (amino acids 35-42 of SEQ ID NO: 443) and RPARRADAGEYRAAVH (amino acids 137-152 of SEQ ID NO: 443) and, optionally, residues DERGRQRGDFSLW (amino acids 123-135 of SEQ ID NO: 443) of LAG3; or residues SPTIPLQDL (amino acids 45-53 of SEQ ID NO: 443) and, optionally DERGRQRGDFSL (amino acids 123-134 of SEQ ID NO: 443) of LAG3; or residues HPLAPGPHPAAPSSWGPRPRRYTVL (amino acids 78-102 of SEQ ID NO: 443) of LAG3; and/or by protecting hydrogens on the amide backbone of such residues from exchange with a deuterium (e.g., from $D_2O$).

The present invention provides a method for making an antibody or antigen-binding fragment thereof that binds specifically to LAG3 comprising administering, to a non-human host animal (e.g., mouse, rabbit, camel, llama or rat), an effective amount of one or more peptides comprising, consisting of or consisting essentially of an amino acid sequence selected from the group consisting of QEGAPAQL (amino acids 35-42 of SEQ ID NO: 443); RPARRADAGEYRAAVH (amino acids 137-152 of SEQ ID NO: 443); DERGRQRGDFSLW (amino acids 123-135 of SEQ ID NO: 443); SPTIPLQDL (amino acids 45-53 of SEQ ID NO: 443); DERGRQRGDFSL (amino acids 123-134 of SEQ ID NO: 443); and HPLAPGPHPAAPSSWGPRPRRYTVL (amino acids 78-102 of SEQ ID NO: 443), e.g., wherein the peptide is formulated with a pharmaceutically acceptable carrier. Optionally, the antibody or fragment is isolated from the host animal, e.g., from the serum or blood of the host animal. Optionally, the host animal is administered more than one dose of the peptide. Such isolated peptides are part of the present invention, e.g., fused to an immunogen such as Keyhole Limpet Hemocyanin (KLH), human serum albumin or bovine serum albumin.

Sequence identity refers to the degree to which the amino acids of two polypeptides are the same at equivalent positions when the two sequences are optimally aligned. Sequence similarity includes identical residues and nonidentical, biochemically related amino acids. Biochemically related amino acids that share similar properties and may be interchangeable are discussed above.

The following references relate to BLAST algorithms often used for sequence analysis: BLAST ALGORITHMS: Altschul et al. (2005) FEBS J. 272(20): 5101-5109; Altschul, S. F., et al., (1990) J. Mol. Biol. 215:403-410; Gish, W., et al., (1993) Nature Genet. 3:266-272; Madden, T. L., et al., (1996) Meth. Enzymol. 266:131-141; Altschul, S. F., et al., (1997) Nucleic Acids Res. 25:3389-3402; Zhang, J., et al., (1997) Genome Res. 7:649-656; Wootton, J. C., et al., (1993) Comput. Chem. 17:149-163; Hancock, J. M. et al., (1994) Comput. Appl. Biosci. 10:67-70; ALIGNMENT SCORING SYSTEMS: Dayhoff, M. O., et al., "A model of evolutionary change in proteins." in Atlas of Protein Sequence and Structure, (1978) vol. 5, suppl. 3. M. O. Dayhoff (ed.), pp. 345-352, Natl. Biomed. Res. Found., Washington, D.C.; Schwartz, R. M., et al., "Matrices for detecting distant relationships." in Atlas of Protein Sequence and Structure, (1978) vol. 5, suppl. 3." M. O. Dayhoff (ed.), pp. 353-358, Natl. Biomed. Res. Found., Washington, D.C.; Altschul, S. F., (1991) J. Mol. Biol. 219:555-565; States, D. J., et al., (1991) Methods 3:66-70; Henikoff, S., et al., (1992) Proc. Natl. Acad. Sci. USA 89:10915-10919; Altschul, S. F., et al., (1993) J. Mol. Evol. 36:290-300; ALIGNMENT STATISTICS: Karlin, S., et al., (1990) Proc. Natl. Acad. Sci. USA 87:2264-2268; Karlin, S., et al., (1993) Proc. Natl. Acad. Sci. USA 90:5873-5877; Dembo, A., et al., (1994) Ann. Prob. 22:2022-2039; and Altschul, S. F. "Evaluating the statistical significance of multiple distinct local alignments." in Theoretical and Computational Methods in Genome Research (S. Suhai, ed.), (1997) pp. 1-14, Plenum, New York.

The anti-LAG3 antibodies or antigen-binding fragments thereof of the present invention (e.g., humanized antibodies such as antagonist humanized antibodies) can comprise one, two, three, four, five, or six of the complementarity determining regions (CDRs) of the immunoglobulin chains disclosed herein (wherein 1, 2, 3, 4, 5 or 6 of the CDRs are, optionally, variants of those set forth herein). The one, two, three, four, five, or six CDRs may be independently selected from the CDR sequences of the various immunoglobulin chains disclosed herein. Alternatively, the one, two, three, four, five, or six CDRs may be selected from the CDR sequences of a single described antibody of the invention.

For example, the present invention includes anti-LAG3 antibodies and antigen-binding fragments thereof as well as immunoglobulin polypeptide chains that comprise:
the 4A10 CDR-H1, CDR-H2 and CDR-H3;
the 4A10 CDR-L1, CDR-L2 and CDR-L3;
the 11C9 CDR-H1, CDR-H2 and CDR-H3;
the 11C9 CDR-L1, CDR-L2 and CDR-L3;
the 19E8 CDR-H1, CDR-H2 and CDR-H3;
the 19E8 CDR-L1, CDR-L2 and CDR-L3;
the 22D2 CDR-H1, CDR-H2 and CDR-H3; and/or
the 22D2 CDR-L1, CDR-L2 and CDR-L3; wherein the 4A10, 11C9, 19E8 and 22D2 CDRs may be derived from the mouse or humanized 4A10, 11C9, 19E8 and 22D2 immunoglobulin chains, respectively, set forth herein (e.g., Ab1, Ab2, Ab3, Ab4, Ab5, Ab6, Ab7, Ab8 or Ab9).

The anti-LAG3 antibodies or antigen-binding fragments thereof of the present invention can comprise at least one antibody heavy chain variable ($V_H$) domain comprising one or more (e.g., 3) of CDR-H1, CDR-H2 or CDR-H3 of 4A10 $V_H$ (e.g., SEQ ID NO: 2); e.g., wherein the CDRs comprise the amino acid sequences set forth in SEQ ID NOs: 3 (or a variant thereof having 1, 2, 3, 4, 5, 6, 7, 8, 9 or 10 point mutations and/or point deletions), 4 (or a variant thereof having 1, 2, 3, 4, 5, 6, 7, 8, 9 or 10 point mutations and/or point deletions), and 5 (or a variant thereof having 1, 2, 3, 4, 5, 6, 7, 8, 9 or 10 point mutations and/or point deletions), respectively.

The anti-LAG3 antibodies or antigen-binding fragments thereof of the present invention can comprise at least one antibody light chain variable ($V_L$) domain comprising one or more (e.g., 3) of CDR-L1, CDR-L2 and CDR-L3 of the 4A10 $V_L$ (e.g., SEQ ID NO: 7); e.g., wherein the CDRs comprise the amino acid sequences set forth in SEQ ID NOs: 8 (or a variant thereof having 1, 2, 3, 4, 5, 6, 7, 8, 9 or 10 point mutations and/or point deletions), 9 (or a variant thereof having 1, 2, 3, 4, 5, 6, 7, 8, 9 or 10 point mutations and/or point deletions) and 10 (or a variant thereof having 1, 2, 3, 4, 5, 6, 7, 8, 9 or 10 point mutations and/or point deletions), respectively.

The anti-LAG3 antibodies or antigen-binding fragments thereof of the present invention can comprise at least one antibody heavy chain variable ($V_H$) domain comprising one or more (e.g., 3) of CDR-H1, CDR-H2 or CDR-H3 of 19E8 $V_H$ (e.g., SEQ ID NO: 12); e.g., wherein the CDRs comprise the amino acid sequences set forth in SEQ ID NOs: 13 (or a variant thereof having 1, 2, 3, 4, 5, 6, 7, 8, 9 or 10 point mutations and/or point deletions), 14 (or a variant thereof having 1, 2, 3, 4, 5, 6, 7, 8, 9 or 10 point mutations and/or point deletions) and 15 (or a variant thereof having 1, 2, 3, 4, 5, 6, 7, 8, 9 or 10 point mutations and/or point deletions), respectively.

The anti-LAG3 antibodies or antigen-binding fragments thereof of the present invention can comprise at least one antibody light chain variable ($V_L$) domain comprising one or more (e.g., 3) of CDR-L1, CDR-L2 and CDR-L3 of 19E8 $V_L$ (e.g., SEQ ID NO: 17); e.g., wherein the CDRs comprise the amino acid sequences set forth in SEQ ID NOs: 18 (or a variant thereof having 1, 2, 3, 4, 5, 6, 7, 8, 9 or 10 point mutations and/or point deletions), 19 (or a variant thereof having 1, 2, 3, 4, 5, 6, 7, 8, 9 or 10 point mutations and/or point deletions) and 20 (or a variant thereof having 1, 2, 3, 4, 5, 6, 7, 8, 9 or 10 point mutations and/or point deletions), respectively.

The anti-LAG3 antibodies or antigen-binding fragments thereof of the present invention can comprise at least one antibody heavy chain variable ($V_H$) domain comprising one or more (e.g., 3) of CDR-H1, CDR-H2 or CDR-H3 of 11C9 $V_H$ (e.g., SEQ ID NO: 22); e.g., wherein the CDRs comprise the amino acid sequences set forth in SEQ ID NOs: 23 (or a variant thereof having 1, 2, 3, 4, 5, 6, 7, 8, 9 or 10 point mutations and/or point deletions), 24 (or a variant thereof having 1, 2, 3, 4, 5, 6, 7, 8, 9 or 10 point mutations and/or point deletions) and 25 (or a variant thereof having 1, 2, 3, 4, 5, 6, 7, 8, 9 or 10 point mutations and/or point deletions), respectively.

The anti-LAG3 antibodies or antigen-binding fragments thereof of the present invention can comprise at least one antibody light chain variable ($V_L$) domain comprising one or more (e.g., 3) of CDR-L1, CDR-L2 and CDR-L3 of the 11C9 $V_L$ (e.g., SEQ ID NO: 27); e.g., wherein the CDRs comprise the amino acid sequences set forth in SEQ ID NOs: 28 (or a variant thereof having 1, 2, 3, 4, 5, 6, 7, 8, 9 or 10 point mutations and/or point deletions), 29 (or a variant thereof having 1, 2, 3, 4, 5, 6, 7, 8, 9 or 10 point mutations and/or point deletions) and 30 (or a variant thereof having 1, 2, 3, 4, 5, 6, 7, 8, 9 or 10 point mutations and/or point deletions), respectively.

The anti-LAG3 antibodies or antigen-binding fragments thereof of the present invention can comprise at least one antibody heavy chain variable ($V_H$) domain comprising one or more (e.g., 3) of CDR-H1, CDR-H2 or CDR-H3 of 22D2 $V_H$ (e.g., SEQ ID NO: 32, 106, 108, 110, 112, 114, 116, 118, 120 or 122); e.g., wherein the CDRs comprise the amino acid sequences set forth in SEQ ID NOs: 33 (or a variant thereof having 1, 2, 3, 4, 5, 6, 7, 8, 9 or 10 point mutations and/or point deletions), 34, 446, 454, 455, 456, 457, or 458 (or a variant thereof having 1, 2, 3, 4, 5, 6, 7, 8, 9 or 10 point mutations and/or point deletions) and 35 (or a variant thereof having 1, 2, 3, 4, 5, 6, 7, 8, 9 or 10 point mutations and/or point deletions), respectively.

The anti-LAG3 antibodies or antigen-binding fragments thereof of the present invention can comprise at least one antibody light chain variable ($V_L$) domain comprising one or more (e.g., 3) of CDR-L1, CDR-L2 and CDR-L3 of 22D2 $V_L$ (e.g., SEQ ID NO: 37 or 126); e.g., wherein the CDRs comprise the amino acid sequences set forth in SEQ ID NOs: 38 (or a variant thereof having 1, 2, 3, 4, 5, 6, 7, 8, 9 or 10 point mutations and/or point deletions), 39 (or a variant thereof having 1, 2, 3, 4, 5, 6, 7, 8, 9 or 10 point mutations and/or point deletions) and 40 (or a variant thereof having 1, 2, 3, 4, 5, 6, 7, 8, 9 or 10 point mutations and/or point deletions), respectively.

The present invention provides an anti-LAG3 antibody or antigen-binding fragment thereof that comprises:
  the 4A10 CDR-H1, CDR-H2 and CDR-H3; and the 4A10 CDR-L1, CDR-L2 and CDR-L3;
  the 11C9 CDR-H1, CDR-H2 and CDR-H3; and the 11C9 CDR-L1, CDR-L2 and CDR-L3;
  the 19E8 CDR-H1, CDR-H2 and CDR-H3; and the 19E8 CDR-L1, CDR-L2 and CDR-L3; or
  the 22D2 CDR-H1, CDR-H2 and CDR-H3; and the 22D2 CDR-L1, CDR-L2 and CDR-L3; wherein the 4A10, 11C9, 19E8 and 22D2 CDRs may be derived from the mouse or humanized 4A10, 11C9, 19E8 and 22D2 immunoglobulin chains, respectively, set forth herein, and wherein, optionally, 1, 2, 3, 4, 5 or 6 of the CDRs are variants of those set forth herein.

The present invention provides an anti-LAG3 antibody or antigen-binding fragment thereof that comprises an antibody light chain variable ($V_L$) domain comprising a CDR-L1, CDR-L2 and CDR-L3 of the 4A10 $V_L$ (e.g., SEQ ID NOs: 8 (or a variant thereof having 1, 2, 3, 4, 5, 6, 7, 8, 9 or 10 point mutations and/or point deletions), 9 (or a variant thereof having 1, 2, 3, 4, 5, 6, 7, 8, 9 or 10 point mutations and/or point deletions) and 10 (or a variant thereof having 1, 2, 3, 4, 5, 6, 7, 8, 9 or 10 point mutations and/or point deletions)); and an antibody heavy chain variable ($V_H$) domain comprising a CDR-H1, CDR-H2 and CDR-H3 of the 4A10 $V_H$ (e.g., SEQ ID NOs: 3 (or a variant thereof having 1, 2, 3, 4, 5, 6, 7, 8, 9 or 10 point mutations and/or point deletions), 4 (or a variant thereof having 1, 2, 3, 4, 5, 6, 7, 8, 9 or 10 point mutations and/or point deletions) and 5 (or a variant thereof having 1, 2, 3, 4, 5, 6, 7, 8, 9 or 10 point mutations and/or point deletions)).

In a further embodiment, an anti-LAG3 antibody or antigen-binding fragment thereof comprises an antibody light chain variable ($V_L$) domain comprising a CDR-L1, CDR-L2 and CDR-L3 of the 19E8 $V_L$ (e.g., SEQ ID NOs: 18 (or a variant thereof having 1, 2, 3, 4, 5, 6, 7, 8, 9 or 10 point mutations and/or point deletions), 19 (or a variant thereof having 1, 2, 3, 4, 5, 6, 7, 8, 9 or 10 point mutations and/or point deletions) and 20 (or a variant thereof having 1, 2, 3, 4, 5, 6, 7, 8, 9 or 10 point mutations and/or point deletions)); and an antibody heavy chain variable ($V_H$) domain comprising a CDR-H1, CDR-H2 and CDR-H3 of the 19E8 $V_H$ (e.g., SEQ ID NOs: 13 (or a variant thereof having 1, 2, 3, 4, 5, 6, 7, 8, 9 or 10 point mutations and/or point deletions), 14 (or a variant thereof having 1, 2, 3, 4, 5, 6, 7, 8, 9 or 10 point mutations and/or point deletions) and 15 (or a variant thereof having 1, 2, 3, 4, 5, 6, 7, 8, 9 or 10 point mutations and/or point deletions)).

In a further embodiment, an anti-LAG3 antibody or antigen-binding fragment thereof comprises an antibody light chain variable ($V_L$) domain comprising a CDR-L1, CDR-L2 and CDR-L3 of the 11C9 $V_L$ (e.g., SEQ ID NOs: 28 (or a variant thereof having 1, 2, 3, 4, 5, 6, 7, 8, 9 or 10 point mutations and/or point deletions), 29 (or a variant thereof having 1, 2, 3, 4, 5, 6, 7, 8, 9 or 10 point mutations and/or point deletions) and 30 (or a variant thereof having 1, 2, 3, 4, 5, 6, 7, 8, 9 or 10 point mutations and/or point deletions)); and an antibody heavy chain variable ($V_H$) domain comprising a CDR-H1, CDR-H2 and CDR-H3 of the 11C9 $V_H$ (e.g., SEQ ID NOs: 23 (or a variant thereof having 1, 2, 3, 4, 5, 6, 7, 8, 9 or 10 point mutations and/or point deletions), 24 (or a variant thereof having 1, 2, 3, 4, 5, 6, 7, 8, 9 or 10 point mutations and/or point deletions) and 25 (or a variant thereof having 1, 2, 3, 4, 5, 6, 7, 8, 9 or 10 point mutations and/or point deletions)).

In a further embodiment, an anti-LAG3 antibody or antigen-binding fragment thereof comprises an antibody light chain variable ($V_L$) domain comprising a CDR-L1, CDR-L2 and CDR-L3 of the 22D2 $V_L$ (e.g., SEQ ID NOs: 38 (or a variant thereof having 1, 2, 3, 4, 5, 6, 7, 8, 9 or 10 point mutations and/or point deletions), 39 (or a variant thereof having 1, 2, 3, 4, 5, 6, 7, 8, 9 or 10 point mutations and/or point deletions) and 40 (or a variant thereof having 1, 2, 3, 4, 5, 6, 7, 8, 9 or 10 point mutations and/or point deletions)); and an antibody heavy chain variable ($V_H$) domain comprising a CDR-H1, CDR-H2 and CDR-H3 of the 22D2 $V_H$ (e.g., SEQ ID NOs: 33 (or a variant thereof having 1, 2, 3, 4, 5, 6, 7, 8, 9 or 10 point mutations and/or point deletions), 34, 446, 454, 455, 456, 457 or 458 (or a variant thereof having 1, 2, 3, 4, 5, 6, 7, 8, 9 or 10 point mutations and/or point deletions) and 35 (or a variant thereof having 1, 2, 3, 4, 5, 6, 7, 8, 9 or 10 point mutations and/or point deletions)).

In a further embodiment, the antibody is a humanized antagonist anti-LAG3 antibody. Examples of such humanized anti-LAG3 antibodies include, but are not limited to, those comprising CDR-L1, CDR-L2 and CDR-L3 of 4A10; and CDR-H1, CDR-H2 and CDR-H3 of 4A10.

In a further embodiment, the antibody is a humanized antagonist anti-LAG3 antibody. Examples of such humanized anti-LAG3 antibodies include, but are not limited to, those comprising CDR-L1, CDR-L2 and CDR-L3 of 19E8; and CDR-H1, CDR-H2 and CDR-H3 of 19E8.

In a further embodiment, the antibody is a humanized antagonist anti-LAG3 antibody. Examples of such humanized anti-LAG3 antibodies include, but are not limited to, those comprising CDR-L1, CDR-L2 and CDR-L3 of 11C9; and CDR-H1, CDR-H2 and CDR-H3 of 11C9.

In a further embodiment, the antibody is a humanized antagonist anti-LAG3 antibody. Examples of such humanized anti-LAG3 antibodies include, but are not limited to, those comprising CDR-L1, CDR-L2 and CDR-L3 of 22D2; and CDR-H1, CDR-H2 and CDR-H3 of 22D2; for example, Ab1, Ab2, Ab3, Ab4, Ab5, Ab6, Ab7, Ab8 or Ab9.

The present invention provides an anti-LAG3 antibody or antigen-binding fragment thereof or an immunoglobulin polypeptide that comprises:
  the mature 4A10 $V_L$ immunoglobulin domain and/or the mature 4A10 $V_H$ domain;
  the mature 19E8 $V_L$ immunoglobulin domain and/or the mature 19E8 $V_H$ domain;
  the mature 11C9 $V_L$ immunoglobulin domain and/or the mature 11C9 $V_H$ domain; and/or
  the mature 22D2 $V_L$ immunoglobulin domain and/or the mature 22D2 $V_H$ domain; wherein the 4A10, 19E8, 11C9 and 22D2 $V_L$ or $V_H$ domain is a mouse or humanized 4A10, 19E8, 11C9 and 22D2 $V_L$ or $V_H$ domain set forth herein, and wherein, optionally, the $V_L$ and/or $V_H$ is a variant of a $V_L$ or $V_H$ set forth herein (e.g., Ab1, Ab2, Ab3, Ab4, Ab5, Ab6, Ab7, Ab8 or Ab9).

The present invention further provides an anti-LAG3 antibody or antigen-binding fragment thereof that comprises the mature $V_L$ domain of 4A10, 19E8, 11C9 or 22D2 wherein the $V_L$ domain comprises the amino acid sequence of SEQ ID NO: 7, 17, 27, 37, 57, 59, 61, 63, 65, 101, 126, 130, 132, 136, 138, 208, 210, 224, 226, 228, 230, 232, 241, 257, 259, 261, 263, 351, 369, 371, 373, 375, 401, 403, 405, 426, 427, 450-453 or 459-461 or a variant thereof.

The present invention further provides an anti-LAG3 antibody or antigen-binding fragment thereof that comprises the mature $V_H$ domain of 4A10, 19E8, 11C9 or 22D2 wherein the $V_H$ domain comprises the amino acid sequence of SEQ ID NO: 2, 12, 22, 32, 45, 47, 49, 51, 53, 55, 67, 69, 71, 73, 75, 77, 79, 81, 83, 85, 87, 89, 91, 93, 95, 97, 99, 103, 106, 108, 110, 112, 114, 116, 118, 120, 122, 124, 128, 134, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 212, 214, 216, 218, 220, 222, 234, 235, 237, 239, 243, 245, 247, 249, 251, 253, 255, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 353, 355, 357, 359, 361, 363, 365, 367, 377, 379, 381, 383, 385, 387, 389, 391, 393, 395, 397, 399, 406-419, 434-442, 448, 449, 462, 463 or 464; or a variant thereof.

The present invention further provides an anti-LAG3 antibody or antigen-binding fragment thereof that comprises the mature $V_L$ domain of 4A10 (e.g., amino acids 21-132 of SEQ ID NO: 7 or a variant thereof) and the mature $V_H$ domain of 4A10 (e.g., amino acids 20-136 of SEQ ID NO: 2 or a variant thereof).

The present invention further provides an anti-LAG3 antibody or antigen-binding fragment thereof that comprises the mature $V_L$ domain of 19E8 (e.g., amino acids 21-128 of SEQ ID NO: 17 or a variant thereof) and the mature $V_H$ domain of 19E8 (e.g., amino acids 20-138 of SEQ ID NO: 12 or a variant thereof).

The present invention further provides an anti-LAG3 antibody or antigen-binding fragment thereof that comprises the mature $V_L$ domain of 11C9 (e.g., amino acids 21-128 of SEQ ID NO: 27 or a variant thereof) and the mature $V_H$ domain of 11C9 (e.g., amino acids 20-142 of SEQ ID NO: 22 or a variant thereof).

The present invention further provides an anti-LAG3 antibody or antigen-binding fragment thereof that comprises the mature $V_L$ domain of 22D2 (e.g., amino acids 21-131 of SEQ ID NO: 37 or 126 or a variant thereof) and the mature $V_H$ domain of 22D2 (e.g., amino acids 21-138 or 21-131 of SEQ ID NO: 32, 106, 108, 110, 112, 114, 116, 118, 120 or 122 or a variant thereof).

The invention also provides polypeptides comprising the amino acid sequence set forth in SEQ ID NO: 2 or amino acids 20-136 thereof or a variant thereof; or any polynucleotide encoding such a polypeptide.

The invention also provides polypeptides comprising the amino acid sequence set forth in SEQ ID NO: 7 or amino acids 21-132 thereof or a variant thereof; or any polynucleotide encoding such a polypeptide.

The invention also provides polypeptides comprising the amino acid sequence set forth in SEQ ID NO: 12 or amino acids 20-138 thereof or a variant thereof; or any polynucleotide encoding such a polypeptide.

The invention also provides polypeptides comprising the amino acid sequence set forth in SEQ ID NO: 17 or amino acids 21-128 thereof or a variant thereof; or any polynucleotide encoding such a polypeptide.

The invention also provides polypeptides comprising the amino acid sequence set forth in SEQ ID NO: 22 or amino acids 20-142 thereof or a variant thereof; or any polynucleotide encoding such a polypeptide.

The invention also provides polypeptides comprising the amino acid sequence set forth in SEQ ID NO: 27 or amino acids 21-128 thereof or a variant thereof; or any polynucleotide encoding such a polypeptide.

The invention also provides polypeptides comprising the amino acid sequence set forth in SEQ ID NO: 32, 106, 108, 110, 112, 114, 116, 118, 120 or 122 or a mature fragment thereof, e.g., comprising amino acids 20-138 or 20-131 thereof; or a variant thereof; or any polynucleotide encoding such a polypeptide.

The invention also provides polypeptides comprising the amino acid sequence set forth in SEQ ID NO: 37 or 126 or a mature fragment thereof, e.g., comprising amino acids 21-131 thereof or a variant thereof; or any polynucleotide encoding such a polypeptide.

The invention also provides polypeptides (e.g., a humanized immunoglobulin chain) comprising the CDR-H1, CDR-H2, and CDR-H3 of a $V_H$ domain comprising SEQ ID NO: 2 (e.g., SEQ ID NOs: 3-5); or any polynucleotide encoding such a polypeptide. Optionally, 1, 2 or 3 of such CDRs are variants of the sequence set forth herein.

The invention also provides polypeptides (e.g., a humanized immunoglobulin chain) comprising the CDR-L1, CDR-L2, and CDR-L3 of a $V_L$ domain comprising SEQ ID NO: 7 (e.g., SEQ ID NOs: 8-10); or any polynucleotide encoding such a polypeptide. Optionally, 1, 2 or 3 of such CDRs are variants of the sequence set forth herein.

The invention also provides polypeptides (e.g., a humanized immunoglobulin chain) comprising the CDR-H1, CDR-H2, and CDR-H3 of a $V_H$ domain comprising SEQ ID NO: 12 (e.g., SEQ ID NOs: 13-15); or any polynucleotide encoding such a polypeptide. Optionally, 1, 2 or 3 of such CDRs are variants of the sequence set forth herein.

The invention also provides polypeptides (e.g., a humanized immunoglobulin chain) comprising the CDR-L1, CDR-L2, and CDR-L3 of a $V_L$ domain comprising SEQ ID NO: 17 (e.g., SEQ ID NOs: 18-20); or any polynucleotide encoding such a polypeptide. Optionally, 1, 2 or 3 of such CDRs are variants of the sequence set forth herein.

The invention also provides polypeptides (e.g., a humanized immunoglobulin chain) comprising the CDR-H1, CDR-H2, and CDR-H3 of a $V_H$ domain comprising SEQ ID NO: 22 (e.g., SEQ ID NOs: 23-25); or any polynucleotide encoding such a polypeptide. Optionally, 1, 2 or 3 of such CDRs are variants of the sequence set forth herein.

The invention also provides polypeptides (e.g., a humanized immunoglobulin chain) comprising the CDR-L1, CDR-L2, and CDR-L3 of a $V_L$ domain comprising SEQ ID NO: 27 (e.g., SEQ ID NOs: 28-30); or any polynucleotide encoding such a polypeptide. Optionally, 1, 2 or 3 of such CDRs are variants of the sequence set forth herein.

The invention also provides polypeptides (e.g., a humanized immunoglobulin chain) comprising the CDR-H1, CDR-H2, and CDR-H3 of a $V_H$ domain comprising SEQ ID NO: 32, 106, 108, 110, 112, 114, 116, 118, 120 or 122 (e.g., SEQ ID NOs: 33, 34 (or 446, 454, 455, 456, 457 or 458) or 35); or any polynucleotide encoding such a polypeptide. Optionally, 1, 2 or 3 of such CDRs are variants of the sequence set forth herein.

The invention also provides polypeptides (e.g., a humanized immunoglobulin chain) comprising the CDR-L1, CDR-L2, and CDR-L3 of a $V_L$ domain comprising SEQ ID NO: 37 or 126 (e.g., SEQ ID NOs: 38-40); or any polynucleotide encoding such a polypeptide. Optionally, 1, 2 or 3 of such CDRs are variants of the sequence set forth herein.

The present invention includes crystalline compositions of the anti-LAG3 antibodies and antigen-binding fragments thereof of the present invention.

Polynucleotides

The present invention further comprises the polynucleotides encoding any of the polypeptides or immunoglobulin chains of anti-LAG3 antibodies and antigen-binding fragments thereof disclosed herein (including variants of the amino acid chains specifically set forth herein). For example, the present invention includes the polynucleotides described in SEQ ID NOs: 1, 6, 11, 16, 21, 26, 31, 36, 46, 48, 50, 52, 54, 56, 56, 58, 60, 62, 64, 66, 68, 70, 72, 74, 76, 78, 80, 82, 84, 86, 88, 90, 92, 94, 96, 98, 100, 102, 104, 105, 107, 109, 111, 113, 115, 117, 119, 121, 123, 125, 127, 129, 131, 133, 135, 137, 139, 141, 143, 145, 147, 149, 151, 153, 155, 157, 159, 161, 163, 165, 167, 169, 171, 173, 175, 177, 179, 181, 183, 185, 187, 189, 191, 193, 195, 197, 199, 201, 203, 205, 207, 209, 211, 213, 215, 217, 219, 221, 223, 225, 227, 229, 231, 233, 236, 238, 240, 242, 244, 246, 248, 250, 252, 254, 256, 258, 260, 262, 264, 266, 268, 270, 272, 274, 276, 278, 280, 282, 284, 286, 288, 290, 292, 294, 296, 298, 300, 302, 304, 306, 308, 310, 312, 314, 316, 318, 320, 322, 324, 326, 328, 330, 332, 334, 336, 338, 340, 342, 344, 346, 348, 350, 352, 354, 356, 358, 360, 362, 364, 366, 368, 370, 372, 374, 376, 378, 380, 382, 384, 386, 388, 390, 392, 394, 396, 398, 400, 402 or 404 and variants thereof (e.g., comprising nucleotide sequences having at least 70%, 80%, 90%, 95% or 99% BLAST sequence identity to such nucleotide sequences (as discussed above)); and polynucleotides encoding the amino acids described therein, e.g., in SEQ ID NOs: 2, 3, 4, 5, 7, 8, 9, 10, 12, 13, 14, 15, 17, 18, 19, 20, 22, 23, 24, 25, 27, 28, 29, 30, 32, 33, 34, 35, 37, 38, 39, 40, 45, 47, 49, 51, 53, 55, 57, 59, 61, 63, 65, 67, 69, 71, 73, 75, 77, 79, 81, 83, 85, 87, 89, 91, 93, 95, 97, 99, 101, 103, 106, 108, 110, 112, 114, 116, 118, 120, 122, 124, 126, 128, 130, 132, 134, 136, 138, 140, 142, 144, 146, 148, 150, 152, 154, 156, 158, 160, 162, 164, 166, 168, 170, 172, 174, 176, 178, 180, 182, 184, 186, 188, 190, 192, 194, 196, 198, 200, 202, 204, 206, 208, 210, 212, 214, 216, 218, 220, 222, 224, 226, 228, 230, 232, 234, 235, 237, 239, 241, 243, 245, 247, 249, 251, 253, 255, 257, 259, 261, 263, 265, 267, 269, 271, 273, 275, 277, 279, 281, 283, 285, 287, 289, 291, 293, 295, 297, 299, 301, 303, 305, 307, 309, 311, 313, 315, 317, 319, 321, 323, 325, 327, 329, 331, 333, 335, 337, 339, 341, 343, 345, 347, 349, 351, 353, 355, 357, 359, 361, 363, 365, 367, 369, 371, 373, 375, 377, 379, 381, 383, 385, 387, 389, 391, 393, 395, 397, 399, 401, 403, 405, 406, 407, 408, 409, 410, 411, 412, 413, 414, 415, 416, 417, 418, 419, 426, 427, 434, 435, 436, 437, 438, 439, 440, 441, 442, 446, 448, 449, 451, 452, 453, 454, 455, 456, 457, 458, 459, 460, 461, 462, 463 or 464. The scope of the present invention also includes variant polynucleotides that hybridize to any of such polynucleotides.

Moreover, the present invention includes anti-LAG3 antibodies and antigen-binding fragments thereof comprising immunoglobulin heavy and light chains (e.g., variable regions thereof) and/or heavy and light chain CDRs encoded by the polynucleotides set forth herein.

For example, the present invention includes anti-LAG3 antibodies and antigen-binding fragments thereof comprising a heavy chain immunoglobulin encoded by a polynucleotide comprising the nucleotide sequence set forth in SEQ ID NO: 107 (or encoding a variable domain thereof) and a light chain immunoglobulin encoded by the nucleotide sequence set forth in SEQ ID NO: 125 (or encoding a variable domain thereof). For example, the present invention also includes anti-LAGS antibodies and antigen-binding fragments thereof comprising a heavy chain immunoglobulin encoded by a polynucleotide comprising the nucleotide sequence set forth in SEQ ID NO: 115 (or encoding a variable domain thereof) and a light chain immunoglobulin encoded by the nucleotide sequence set forth in SEQ ID NO: 125 (or encoding a variable domain thereof).

The present invention provides polynucleotide encoding the

4A10 $V_L$ or a mature fragment thereof;
4A10 $V_H$ or a mature fragment thereof;
19E8 $V_L$ or a mature fragment thereof;
19E8 $V_H$ or a mature fragment thereof;
11C9 $V_L$ or a mature fragment thereof;
11C9 $V_H$ or a mature fragment thereof;
22D2 $V_L$ or a mature fragment thereof; and/or
22D2 $V_H$ or a mature fragment thereof; wherein the 4A10, 19E8, 11C9 and 22D2 $V_L$ or $V_H$ domain is a mouse or humanized 4A10, 19E8, 11C9 and 22D2 $V_L$ or $V_H$ domain set forth herein, and wherein, optionally, the $V_L$ and/or $V_H$ is a variant of a $V_L$ or $V_H$ set forth herein.

The invention also provides polynucleotide comprising the nucleotide sequence set forth in SEQ ID NO: 1 or nucleotide 58-408 thereof; or a variant thereof.

The invention also provides polynucleotide comprising the nucleotide sequence set forth in SEQ ID NO: 6 or nucleotide 61-396 thereof; or a variant thereof.

The invention also provides polynucleotide comprising the nucleotide sequence set forth in SEQ ID NO:11 or nucleotide 58-414 thereof; or a variant thereof.

The invention also provides polynucleotides comprising the nucleotide sequence set forth in SEQ ID NO: 16 or nucleotide 61-384 thereof; or a variant thereof.

The invention also provides polynucleotides comprising the nucleotide sequence set forth in SEQ ID NO: 21 or nucleotide 58-426 thereof; or a variant thereof.

The invention also provides polynucleotides comprising the nucleotide sequence set forth in SEQ ID NO: 26 or nucleotide 61-384 thereof; or a variant thereof.

The invention also provides polynucleotides comprising the nucleotide sequence set forth in SEQ ID NO: 31 or nucleotide 61-447 thereof; or a variant thereof.

The invention also provides polynucleotides comprising the nucleotide sequence set forth in SEQ ID NO: 36 or nucleotide 61-547 thereof; or a variant thereof.

Variant polynucleotides set forth herein include those that hybridize under low, moderate or high stringency conditions to the polynucleotides set forth herein or to polynucleotides that encode the polypeptides set forth herein, and encode immunoglobulin chains of anti-LAG3 antibodies or antigen-binding fragments thereof which maintain the ability to specifically bind to LAG3 (human and/or cynomolgus monkey, e.g., *Macaca fascicularis* or *Macaca mulatta*). A first polynucleotide molecule is "hybridizable" to a second polynucleotide molecule when a single stranded form of the first polynucleotide molecule can anneal to the second polynucleotide molecule under the appropriate conditions of temperature and solution ionic strength (see Sambrook, et al., supra). The conditions of temperature and ionic strength determine the "stringency" of the hybridization. Typical low stringency hybridization conditions include 55° C., 5×SSC, 0.1% SDS and no formamide; or 30% formamide, 5×SSC, 0.5% SDS at 42° C. Typical moderate stringency hybridization conditions are 40% formamide, with 5× or 6×SSC and 0.1% SDS at 42° C. High stringency hybridization conditions are 50% formamide, 5× or 6×SSC at 42° C. or, optionally, at a higher temperature (e.g., 57° C., 59° C., 60° C., 62° C., 63° C., 65° C. or 68° C.). In general, SSC is 0.15M NaCl and 0.015M Na-citrate. Hybridization requires that the two polynucleotide contain complementary sequences, although, depending on the stringency of the hybridization, mismatches between bases are possible. The appropriate stringency for hybridizing polynucleotides depends on the length of the polynucleotides and the degree of complementation, variables well known in the art. The greater the degree of similarity or homology between two nucleotide sequences, the higher the stringency under which the nucleic acids may hybridize. For hybrids of greater than 100 nucleotides in length, equations for calculating the melting temperature have been derived (see Sambrook, et al., supra, 9.50-9.51). For hybridization with shorter polynucleotides, e.g., oligonucleotides, the position of mismatches becomes more important, and the length of the oligonucleotide determines its specificity (see Sambrook, et al., supra, 11.7-11.8).

In another embodiment of the invention, an polynucleotide, for example DNA, encoding the immunoglobulin polypeptide chains of the anti-LAG3 antibodies or antigen-binding fragments set forth herein forms part of the present invention. In one embodiment, the polynucleotide encodes at least one mature immunoglobulin polypeptide light chain variable ($V_L$) domain and at least one mature immunoglobulin polypeptide heavy chain variable ($V_H$) domain, wherein the $V_L$ domain comprises a CDR-L1, CDR-L2 and CDR-L3 having a sequence selected from SEQ ID NOs: 8-10, 18-20 28-30 and 38-40, and the $V_H$ domain comprises CDR-H1, CDR-H2 and CDR-H3 having a sequence selected from SEQ ID NOs: 3-5, 13-15, 23-25 and 33-35. In one embodiment, the nucleic acid encodes the 4A10, 11C9, 19E8 or 22D2 mature light chain variable region and/or the 4A10, 11C9, 19E8 or 22D2 mature heavy chain variable region sequences. In some embodiments of the invention, the polynucleotide encodes both a light chain and a heavy chain on a single polynucleotide molecule, and, in other embodiments of the invention, the light and heavy chains are encoded on separate polynucleotide molecules, e.g., in separate or common host cells. In another embodiment the polynucleotides further encodes a signal sequence.

In one embodiment of the invention, the polynucleotide encodes a mature immunoglobulin light chain variable ($V_L$) domain comprising the CDR-L1, CDR-L2 and CDR-L3 of SEQ ID NO: 7. Variants of such polynucleotides are also part of the present invention.

In one embodiment of the invention, the polynucleotide encodes a mature immunoglobulin light chain variable ($V_L$) domain comprising the CDR-L1, CDR-L2 and CDR-L3 of SEQ ID NO: 17. Variants of such polynucleotides are also part of the present invention.

In one embodiment of the invention, the polynucleotide encodes a mature immunoglobulin light chain variable ($V_L$) domain comprising the CDR-L1, CDR-L2 and CDR-L3 of SEQ ID NO: 27. Variants of such polynucleotides are also part of the present invention.

In one embodiment of the invention, the polynucleotide encodes a mature immunoglobulin light chain variable ($V_L$) domain comprising the CDR-L1, CDR-L2 and CDR-L3 of SEQ ID NO: 37 or 126. Variants of such polynucleotides are also part of the present invention.

In one embodiment of the invention, the polynucleotide encodes a mature immunoglobulin heavy chain variable ($V_H$) domain comprising the CDR-H1, CDR-H2 and CDR-H3 of SEQ ID NO: 2. Variants of such polynucleotides are also part of the present invention.

In one embodiment of the invention, the polynucleotide encodes a mature immunoglobulin heavy chain variable ($V_H$) domain comprising the CDR-H1, CDR-H2 and CDR-H3 of SEQ ID NO: 12. Variants of such polynucleotides are also part of the present invention.

In one embodiment of the invention, the polynucleotide encodes a mature immunoglobulin heavy chain variable ($V_H$) domain comprising the CDR-H1, CDR-H2 and CDR-H3 of SEQ ID NO: 22. Variants of such polynucleotides are also part of the present invention.

In one embodiment of the invention, the polynucleotide encodes a mature immunoglobulin heavy chain variable ($V_H$) domain comprising the CDR-H1, CDR-H2 and CDR-H3 of SEQ ID NO: 32, 106, 108, 110, 112, 114, 116, 118, 120 or 122. Variants of such polynucleotides are also part of the present invention.

In one embodiment of the invention, the polynucleotide encodes the immunoglobulin light chain variable ($V_L$) domain of SEQ ID NO: 7, 17, 27 and/or 37. Variants of such polynucleotides are also part of the present invention.

In one embodiment of the invention, the polynucleotide encodes the immunoglobulin heavy chain variable ($V_H$) domain of SEQ ID NO: 2, 12, 22, 32, 106, 108, 110, 112, 114, 116, 118, 120 and/or 122. Variants of such polynucleotides are also part of the present invention.

This present invention also provides vectors, e.g., expression vectors, such as plasmids, comprising the polynucleotides of the invention (sequences set forth herein and variants thereof, e.g., SEQ ID NO: 125, 105, 107, 109, 111, 113, 115, 117, 119 and/or 121), wherein the polynucleotide is operably linked to control sequences that are recognized by a host cell when the host cell is transfected with the vector. Also provided are host cells comprising a polynucleotide (e.g., integrated into the genome, e.g., a chromosome, of the host cell) or vector of the present invention and methods for producing the antibody or antigen-binding fragment thereof or polypeptide disclosed herein comprising culturing a host cell harboring an expression vector or polynucleotide encoding the immunoglobulin chains of the antibody or antigen-binding fragment thereof in culture medium, and isolating the antigen or antigen-binding fragment thereof from the host cell or culture medium.

Binding Affinity

By way of example, and not limitation, the anti-LAG3 antibodies and antigen-binding fragments thereof disclosed herein bind human and/or cynomolgous monkey, e.g., *Macaca fascicularis* or *Macaca mulatta* LAG3, e.g., with a $K_D$ value of at least about 100 nM ($1\times10^{-7}$ M); at least about 10 nM; or at least about 1 nM. In further embodiments, the antibodies have $K_D$ values of at least about 200 pM ($2\times10^{-10}$ M), 100 pM, 50 pM, 20 pM, 10 pM, 5 pM or even 2 pM. For example, the $K_D$ is about $2.77\times10^{-12}$ M, $1.47\times10^{-11}$ M, $1.47\times10^{-09}$ M, or $9.03\times10^{-11}$ M; or a higher affinity. In an embodiment of the invention, the $K_D$ is as measured in a KinExA assay or similar kinetic exclusion assay. See e.g., Darling et al. Assay and Drug Dev. Tech. 2(6): 647-657 (2004).

Methods of Making Antibodies and Antigen-binding Fragments Thereof

Hybridoma cells that produce parental (e.g., mouse) monoclonal anti-LAG3 antibodies or antigen-binding fragments thereof discussed herein may be produced by methods which are commonly known in the art. Such isolated hybridomas are part of the present invention. These methods include, but are not limited to, the hybridoma technique originally developed by Kohler, et al., (1975) (Nature 256: 495-497), as well as the trioma technique (Hering, et al., (1988) Biomed. Biochim. Acta. 47:211-216 and Hagiwara, et al., (1993) Hum. Antibod. Hybridomas 4:15), the human B-cell hybridoma technique (Kozbor, et al., (1983) Immunology Today 4:72 and Cote, et al., (1983) Proc. Natl. Acad. Sci. U.S.A 80:2026-2030), the EBV-hybridoma technique (Cole, et al., in *Monoclonal Antibodies and Cancer Therapy*, Alan R. Liss, Inc., pp. 77-96, 1985), and electric field based electrofusion using a Cyto Pulse large chamber cull fusion electroporator (Cyto Pulse Sciences, Inc., Glen Burnie, Md.). Preferably, mouse splenocytes are isolated and fused with PEG or by electrofusion to a mouse myeloma cell line based upon standard protocols. The resulting hybridomas may then be screened for the production of antigen-specific antibodies. For example, single cell suspensions of splenic lymphocytes from immunized mice may by fused to one-sixth the number of P3X63-Ag8.653 nonsecreting mouse myeloma cells (ATCC, CRL 1580) with 50% PEG. Cells may be plated at approximately $2\times10^5$ cells/mL in a flat bottom microtiter plate, followed by a two week incubation in selective medium containing 20% fetal Clone Serum, 18% "653" conditioned media, 5% origen (IGEN), 4 mM L-glutamine, 1 mM L-glutamine, 1 mM sodium pyruvate, 5 mM HEPES, 0.055 mM 2-mercaptoethanol, 50 units/ml penicillin, 50 mg/ml streptomycin, 50 mg/ml gentamycin and 1×HAT (Sigma; the HAT is added 24 hours after the fusion). After two weeks, cells may be cultured in medium in which the HAT is replaced with HT. Individual wells may then be screened by ELISA for anti-LAGS monoclonal IgG antibodies. Once extensive hybridoma growth occurs, medium can be observed usually after 10-14 days. The antibody secreting hybridomas may be replated, screened again, and if still positive for human IgG, anti-LAGS monoclonal antibodies, can be subcloned at least twice by limiting dilution. The stable subclones may then be cultured in vitro to generate small amounts of antibody in tissue culture medium for characterization.

Thus, the present invention includes methods for making an anti-LAG3 antibody or antigen-binding fragment thereof of the present invention comprising culturing a hybridoma cell that expresses the antibody or fragment under condition favorable to such expression and, optionally, isolating the antibody or fragment from the hybridoma.

The anti-LAG3 antibodies disclosed herein may also be produced recombinantly (e.g., in an *E. coli*/T7 expression system). In this embodiment, nucleic acids encoding the anti-LAG3 antibody immunoglobulin molecules of the invention (e.g., $V_H$ or $V_L$; e.g., any one or more of SEQ ID NO: 125, 105, 107, 109, 111, 113, 115, 117, 119 and/or 121) may be inserted into a pET-based plasmid and expressed in the *E. coli*/T7 system. For example, the present invention includes methods for expressing an antibody or antigen-binding fragment thereof or immunoglobulin chain thereof in a host cell (e.g., bacterial host cell such as *E. coli* such as BL21 or BL21DE3) comprising expressing T7 RNA polymerase in the cell which also includes a polynucleotide encoding an immunoglobulin chain that is operably linked to a T7 promoter. For example, in an embodiment of the invention, a bacterial host cell, such as a *E. coli*, includes a polynucleotide encoding the T7 RNA polymerase gene operably linked to a lac promoter and expression of the polymerase and the chain is induced by incubation of the host cell with IPTG (isopropyl-beta-D-thiogalactopyranoside).

There are several methods by which to produce recombinant antibodies which are known in the art. One example of a method for recombinant production of antibodies is disclosed in U.S. Pat. No. 4,816,567.

Transformation can be by any known method for introducing polynucleotides into a host cell. Methods for introduction of heterologous polynucleotides into mammalian cells are well known in the art and include dextran-mediated transfection, calcium phosphate precipitation, polybrene-mediated transfection, protoplast fusion, electroporation, encapsulation of the polynucleotide(s) in liposomes, biolistic injection and direct microinjection of the DNA into nuclei. In addition, nucleic acid molecules may be introduced into mammalian cells by viral vectors. Methods of transforming cells are well known in the art. See, for example, U.S. Pat. Nos. 4,399,216; 4,912,040; 4,740,461 and 4,959,455.

Thus, the present invention includes recombinant methods for making an anti-LAG3 antibody or antigen-binding fragment thereof of the present invention, or an immunoglobulin chain thereof, comprising (i) introducing a polynucleotide (e.g., any one or more of SEQ ID NO: 125, 105, 107, 109, 111, 113, 115, 117, 119 and/or 121) encoding one or more immunoglobulin chains of the antibody or fragment (e.g., heavy chain immunoglobulin of 4A10, 19E8, 11C9 and/or 22D2; e.g., Ab1, Ab2, Ab3, Ab4, Ab5, Ab6, Ab7, Ab8 and/or Ab9 and/or light chain immunoglobulin of 4A10, 19E8, 11C9 and/or 22D2; e.g., Ab1, Ab2, Ab3, Ab4, Ab5, Ab6, Ab7, Ab8 and/or Ab9), for example, wherein the polynucleotide is in a vector and/or is operably linked to a promoter; (ii) culturing the host cell (e.g., CHO or *Pichia* or *Pichia pastoris*) under condition favorable to expression of the polynucleotide and, (iii) optionally, isolating the antibody or fragment or chain from the host cell and/or medium in which the host cell is grown. When making an antibody or antigen-binding fragment comprising more than one immunoglobulin chain, e.g., an antibody that comprises two heavy immunoglobulin chains and two light immunoglobulin chains, co-expression of the chains in a single host cell leads to association of the chains, e.g., in the cell or on the cell surface or outside the cell if such chains are secreted, so as to form the antibody or antigen-binding fragment molecule. The methods include those wherein only a heavy immunoglobulin chain or only a light immunoglobulin chain (e.g., any of those discussed herein including mature fragments and/or variable domains thereof) is expressed. Such chains are useful, for example, as intermediates in the expression of an antibody or antigen-binding fragment that includes such a chain. For example, the present invention also includes anti-LAG3 antibodies and antigen-binding fragments thereof comprising a heavy chain immunoglobulin (or variable domain thereof or comprising the CDRs thereof) encoded by a polynucleotide comprising the nucleotide sequence set forth in SEQ ID NO: 115 (or encoding a variable domain thereof) and a light chain immunoglobulin (or variable domain thereof or comprising the CDRs thereof) encoded by the nucleotide sequence set forth in SEQ ID NO: 125 (or encoding a variable domain thereof) which are the product of such production methods, and, optionally, the purification methods set forth herein.

Anti-LAG3 antibodies can also be synthesized by any of the methods set forth in U.S. Pat. No. 6,331,415.

Eukaryotic and prokaryotic host cells, including mammalian cells as hosts for expression of the anti-LAG3 antibodies or fragments or immunoglobulin chains disclosed herein are well known in the art and include many immortalized cell lines available from the American Type Culture Collection (ATCC). These include, inter alia, Chinese hamster ovary (CHO) cells, NSO, SP2 cells, HeLa cells, baby hamster kidney (BHK) cells, monkey kidney cells (COS), human hepatocellular carcinoma cells (e.g., Hep G2), A549 cells, 3T3 cells, HEK-293 cells and a number of other cell lines. Mammalian host cells include human, mouse, rat, dog, monkey, pig, goat, bovine, horse and hamster cells. Cell lines of particular preference are selected through determining which cell lines have high expression levels. Other cell lines that may be used are insect cell lines (e.g., *Spodoptera frugiperda* or *Trichoplusia ni*), amphibian cells, bacterial cells, plant cells and fungal cells. Fungal cells include yeast and filamentous fungus cells including, for example, *Pichia pastoris, Pichia finlandica, Pichia trehalophila, Pichia koclamae, Pichia membranaefaciens, Pichia minuta (Ogataea minuta, Pichia lindneri), Pichia opuntiae, Pichia thermotolerans, Pichia salictaria, Pichia guercuum, Pichia pijperi, Pichia stiptis, Pichia methanolica, Pichia* sp., *Saccharomyces cerevisiae, Saccharomyces* sp., *Hansenula polymorpha, Kluyveromyces* sp., *Kluyveromyces lactis, Candida albicans, Aspergillus nidulans, Aspergillus niger, Aspergillus oryzae, Trichoderma reesei, Chrysosporium lucknowense, Fusarium* sp., *Fusarium gramineum, Fusarium venenatum, Physcomitrella patens* and *Neurospora crassa. Pichia* sp., any *Saccharomyces* sp., *Hansenula polymorpha*, any *Kluyveromyces* sp., *Candida albicans*, any *Aspergillus* sp., *Trichoderma reesei, Chrysosporium lucknowense*, any *Fusarium* sp., *Yarrowia lipolytica*, and *Neurospora crassa*.

Further, expression of antibodies and antigen-binding fragments thereof and immunoglobulin chains of the invention (or other moieties therefrom) from production cell lines can be enhanced using a number of known techniques. For example, the glutamine synthetase gene expression system (the GS system) is a common approach for enhancing expression under certain conditions. The GS system is discussed in whole or part in connection with European Patent Nos. 0 216 846, 0 256 055, and 0 323 997 and European Patent Application No. 89303964.4. Thus, in an embodiment of the invention, the mammalian host cells (e.g., CHO) lack a glutamine synthetase gene and are grown in the absence of glutamine in the medium wherein, however, the polynucleotide encoding the immunoglobulin chain comprises a glutamine synthetase gene which complements the lack of the gene in the host cell.

The present invention includes methods for purifying an anti-LAG3 antibody or antigen-binding fragment thereof of the present invention comprising introducing a sample (e.g., culture medium, cell lysate or cell lysate fraction, e.g., a soluble fraction of the lysate) comprising the antibody or fragment to a purification medium (e.g., cation-exchange medium, anion-exchange medium, hydrophobic exchange medium, affinity purification medium (e.g., protein-A, protein-G, protein-A/G, protein-L)) and either collecting purified antibody or fragment from the flow-through fraction of said sample that does not bind to the medium; or, discarding the flow-through fraction and eluting bound antibody or fragment from the medium and collecting the eluate. In an embodiment of the invention, the medium is in a column to which the sample is applied. In an embodiment of the invention, the purification method is conducted following recombinant expression of the antibody or fragment in a host cell, e.g., wherein the host cell is first lysed and, optionally, the lysate is purified of insoluble materials prior to purification on a medium; or wherein the antibody or fragment is secreted into the culture medium by the host cell and the medium or a fraction thereof is applied to the purification medium.

In general, glycoproteins produced in a particular cell line or transgenic animal will have a glycosylation pattern that is characteristic for glycoproteins produced in the cell line or transgenic animal. Therefore, the particular glycosylation pattern of an antibody will depend on the particular cell line or transgenic animal used to produce the antibody. However, all antibodies encoded by the nucleic acid molecules provided herein, or comprising the amino acid sequences provided herein, comprise the instant invention, independent of the glycosylation pattern the antibodies may have. Similarly, in particular embodiments, antibodies with a glycosylation pattern comprising only non-fucosylated N-glycans may be advantageous, because these antibodies have been shown to typically exhibit more potent efficacy than their fucosylated counterparts both in vitro and in vivo (See for example, Shinkawa et al., J. Biol. Chem. 278: 3466-3473 (2003); U.S. Pat. Nos. 6,946,292 and 7,214,775). These antibodies with non-fucosylated N-glycans are not likely to be immunogenic because their carbohydrate structures are a normal component of the population that exists in human serum IgG.

Figure 6:
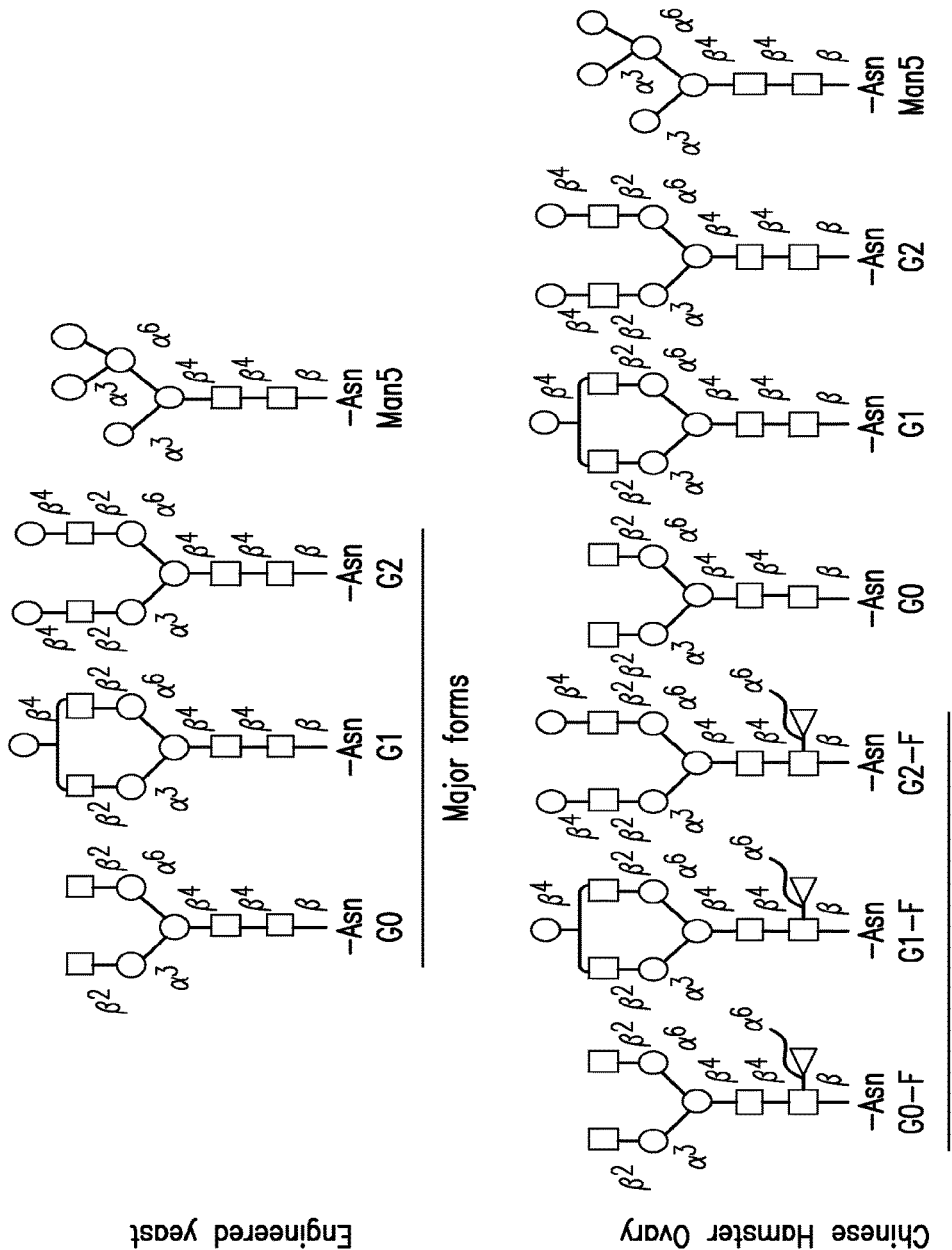
FIG. 6. Predominant N-linked glycans for monoclonal antibodies produced in Chinese hamster ovary cells (CHO N-linked glycans) and in engineered yeast cells (engineered yeast N-linked glycans): squares: N-acetylglucosamine (GlcNac); circles: mannose (Man); diamonds: galactose (Gal); triangles: fucose (Fuc).

The present invention includes anti-LAG3 antibodies and antigen-binding fragments thereof (e.g., 4A10, 19E8, 11C9 and/or 22D2; e.g., Ab1, Ab2, Ab3, Ab4, Ab5, Ab6, Ab7, Ab8 and/or Ab9) comprising N-linked glycans that are typically added to immunoglobulins produced in Chinese hamster ovary cells (CHO N-linked glycans) or to engineered yeast cells (engineered yeast N-linked glycans), such as, for example, *Pichia pastoris*. For example, in an embodiment of the invention, the antibody or antigen-binding fragment comprises one or more of the "engineered yeast N-linked glycans" or "CHO N-linked glycans" that are set forth in FIG. 6 (e.g., G0 and/or G0-F and/or G1 and/or G1-F and/or G2-F and/or Man5). In an embodiment of the invention, the antibody or antigen-binding fragment comprises the engineered yeast N-linked glycans, i.e., G0 and/or G1 and/or G2, optionally, further including Man5. In an embodiment of the invention, the antibody or antigen-binding fragment comprise the CHO N-linked glycans, i.e., G0-F, G1-F and G2-F, optionally, further including G0 and/or G1 and/or G2 and/or Man5. In an embodiment of the invention, about 80% to about 95% (e.g., about 80-90%, about 85%, about 90% or about 95%) of all N-linked glycans on the antibody or antigen-binding fragment immunoglobulin chains are engineered yeast N-linked glycans or CHO N-linked glycans. See Nett et al. Yeast. 28(3): 237-252 (2011); Hamilton et al. Science. 313(5792): 1441-1443 (2006); Hamilton et al. Curr Opin Biotechnol. 18(5): 387-392 (2007). For example, in an embodiment of the invention, an engineered yeast cell is GFI5.0 or YGLY8316 or strains set forth in U.S. Pat. No. 7,795,002 or Zha et al. Methods Mol Biol. 988:31-43 (2013). See also international patent application publication no. WO2013/066765.

The present invention includes polyclonal anti-LAG3 antibodies and antigen-binding fragments thereof, e.g., a composition comprising a plurality of anti-LAG3 antibodies and fragments, which include one or more of the anti-LAG3 antibodies or antigen-binding fragments thereof of the present invention (e.g., Ab1, Ab2, Ab3, Ab4, Ab5, Ab6, Ab7, Ab8 or Ab9), and methods of use thereof. A polyclonal antibody is an antibody which was produced among or in the presence of one or more other, non-identical antibodies. In general, polyclonal antibodies are produced from collections of different B-lymphocytes, e.g., the B-lymphocyte of an animal treated with an immunogen of interest, which produces a population of different antibodies but which are all directed to the immunogen. Usually, polyclonal antibodies are obtained directly from an immunized animal, e.g., spleen, serum or ascites fluid.

The present invention includes "antagonist" anti-LAG3 antibodies and antigen-binding fragments thereof and methods of use thereof, e.g., humanized, antagonist anti-LAG3 antibodies and fragments. An antagonist anti-LAG3 antibody or antigen-binding fragment thereof antagonizes an activity of LAG3 (e.g., human LAG3) such as by inhibiting LAG3 binding to MHC class II molecules; competing with MHC class II molecules for LAG3 binding; or when a cell or subject is contacted with the antibody or fragment, a biological phenotype associated with LAG3 antagonism, such as stimulation of antigen-specific T-cell production of IL-2, is produced.

The present invention includes bispecific and bifunctional antibodies and antigen-binding fragments having a binding specificity for LAG3 and another antigen such as, for example, PD-1 or PD-L1, and methods of use thereof. In an embodiment of the invention, the anti-PD1 chains comprise the amino acid sequence of SEQ ID NOs: 41 and 42 or of SEQ ID NOs: 43 and 44. A bispecific or bifunctional antibody is an artificial hybrid antibody having two different heavy/light chain pairs and two different binding sites. Bispecific antibodies can be produced by a variety of methods including fusion of hybridomas or linking of Fab' fragments. See, e.g., Songsivilai, et al., (1990) Clin. Exp. Immunol. 79: 315-321, Kostelny, et al., (1992) J Immunol. 148:1547-1553. In addition, bispecific antibodies may be formed as "diabodies" (Holliger, et al., (1993) PNAS USA 90:6444-6448) or as "Janusins" (Traunecker, et al., (1991) EMBO J. 10:3655-3659 and Traunecker, et al., (1992) Int. J. Cancer Suppl. 7:51-52).

The present invention further includes anti-LAG3 antigen-binding fragments of the anti-LAG3 antibodies disclosed herein. The antibody fragments include $F(ab)_2$ fragments, which may be produced by enzymatic cleavage of an IgG by, for example, pepsin. Fab fragments may be produced by, for example, reduction of $F(ab)_2$ with dithiothreitol or mercaptoethylamine. A Fab fragment is a $V_L$-$C_L$ chain appended to a $V_H$-$C_{H1}$ chain by a disulfide bridge. A $F(ab)_2$ fragment is two Fab fragments which, in turn, are appended by two disulfide bridges. The Fab portion of an $F(ab)_2$ molecule includes a portion of the $F_c$ region between which disulfide bridges are located. An $F_v$ fragment is a $V_L$ or $V_H$ region.

Immunoglobulins may be assigned to different classes depending on the amino acid sequences of the constant domain of their heavy chains. There are at least five major classes of immunoglobulins: IgA, IgD, IgE, IgG and IgM, and several of these may be further divided into subclasses (isotypes), e.g. IgG-1, IgG-2, IgG-3 and IgG-4; IgA-1 and IgA-2. The invention comprises anti-LAG3 antibodies and antigen-binding fragments of any of these classes or subclasses of antibodies.

In one embodiment, the anti-LAG3 antibody or antigen-binding fragment comprises a heavy chain constant region, e.g. a human constant region, such as γ1, γ2, γ3, or γ4 human heavy chain constant region or a variant thereof. In another embodiment, the anti-LAG3 antibody or antigen-binding fragment comprises a light chain constant region, e.g. a human light chain constant region, such as lambda or kappa human light chain region or variant thereof. By way of example, and not limitation, the human heavy chain constant region can be γ4 and the human light chain constant region can be kappa. In an alternative embodiment, the Fc region of the antibody is γ4 with a Ser228Pro mutation (Schuurman, J et. al., *Mol. Immunol.* 38: 1-8, 2001).

In some embodiments, different constant domains may be appended to humanized $V_L$ and $V_H$ regions derived from the CDRs provided herein. For example, if a particular intended use of an antibody (or fragment) of the present invention were to call for altered effector functions, a heavy chain constant domain other than human IgG1 may be used, or hybrid IgG1/IgG4 may be utilized.

Although human IgG1 antibodies provide for long half-life and for effector functions, such as complement activation and antibody-dependent cellular cytotoxicity, such activities may not be desirable for all uses of the antibody. In such instances a human IgG4 constant domain, for example, may be used. The present invention includes anti-LAG3 antibodies and antigen-binding fragments thereof which comprise an IgG4 constant domain, e.g., antagonist, humanized anti-LAG3 antibodies and fragments, and methods of use thereof. In one embodiment, the IgG4 constant domain can differ from the native human IgG4 constant domain (Swiss-Prot Accession No. P01861.1) at a position corresponding to position 228 in the EU system and position 241 in the KABAT system, where the native Ser108 is replaced with Pro, in order to prevent a potential inter-chain disulfide bond between Cys106 and Cys109 (corresponding to positions Cys 226 and Cys 229 in the EU system and positions Cys 239 and Cys 242 in the KABAT system) that could interfere with proper intra-chain disulfide bond formation. See Angal et al. (1993) *Mol. Imunol.* 30:105. In other instances, a modified IgG1 constant domain which has been modified to increase half-life or reduce effector function can be used.

Antibody Engineering

Further included are embodiments in which the anti-LAG3 antibodies and antigen-binding fragments thereof are engineered antibodies to include modifications to framework residues within the variable domains of a parental (e.g., mouse) monoclonal antibody, e.g. to improve the properties of the antibody or fragment. Typically, such framework modifications are made to decrease the immunogenicity of the antibody or fragment. This is usually accomplished by replacing non-CDR residues in the variable domains (i.e. framework residues) in a parental (e.g. rodent) antibody or fragment with analogous residues from the immune repertoire of the species in which the antibody is to be used, e.g. human residues in the case of human therapeutics. Such an antibody or fragment is referred to as a "humanized" antibody or fragment. In some cases it is desirable to increase the affinity, or alter the specificity of an engineered (e.g. humanized) antibody. One approach is to "backmutate" one or more framework residues to the corresponding germline sequence. More specifically, an antibody or fragment that has undergone somatic mutation can contain framework residues that differ from the germline sequence from which the antibody is derived. Such residues can be identified by comparing the antibody or fragment framework sequences to the germline sequences from which the antibody or fragment is derived. Another approach is to revert to the original parental (e.g., rodent) residue at one or more positions of the engineered (e.g. humanized) antibody, e.g. to restore binding affinity that may have been lost in the process of replacing the framework residues. (See, e.g., U.S. Pat. Nos. 5,693,762, 5,585,089 and U.S. Pat. No. 5,530, 101.) For example, Table 2, below, shows regions where a framework region amino acid position (using Kabat numbering system) differs from the germline and how this position can be backmutated to the germline by the indicated substitutions:

TABLE 2

Exemplary Backmutations

| Region | Framework Amino Acid Position (Kabat Numbering) | Backmutation-examples |
|---|---|---|
| AbA V$_H$ | 25 | H25S |
| AbAV$_H$ | 68 | S68T |
| AbA V$_H$ | 82a | T82aT |

Another type of framework modification involves mutating one or more residues within the framework region, or even within one or more CDR regions, to remove T cell epitopes to thereby reduce the potential immunogenicity of the antibody. This approach is also referred to as "deimmunization" and is described in further detail in U.S. Pat. No. 7,125,689.

In particular embodiments, it will be desirable to change certain amino acids containing exposed side-chains to another amino acid residue in order to provide for greater chemical stability of the final antibody, as follows. Such changes in the antigen-binding region can alter the binding to the antigen. The deamidation of asparagine may occur on N-G or D-G sequences and result in the creation of an isoaspartic acid residue that introduces a kink into the polypeptide chain and decreases its stability (isoaspartic acid effect). In certain embodiments, the antibodies of the present disclosure do not contain asparagine isomerism sites.

For example, an asparagine (Asn) residue may be changed to Gln or Ala to reduce the potential for formation of isoaspartate at any Asn-Gly sequences, particularly within a CDR. A similar problem may occur at a Asp-Gly sequence. Reissner and Aswad (2003) *Cell. Mol. Life Sci.* 60:1281. Isoaspartate formation may debilitate or completely abrogate binding of an antibody to its target antigen. See, Presta (2005) *J. Allergy Clin. Immunol.* 116:731 at 734. In one embodiment, the asparagine is changed to glutamine (Gln). It may also be desirable to alter an amino acid adjacent to an asparagine (Asn) or glutamine (Gln) residue to reduce the likelihood of deamidation, which occurs at greater rates when small amino acids occur adjacent to asparagine or glutamine. See, Bischoff & Kolbe (1994) *J. Chromatog.* 662:261. In addition, any methionine residues (typically solvent exposed Met) in CDRs may be changed to Lys, Leu, Ala, or Phe or other amino acids in order to reduce the possibility that the methionine sulfur would oxidize, which could reduce antigen-binding affinity and also contribute to molecular heterogeneity in the final antibody preparation. Id. In one embodiment of the invention, the methionine is changed to alanine (Ala). Additionally, in order to prevent or minimize potential scissile Asn-Pro peptide bonds, it may be desirable to alter any Asn-Pro combinations found in a CDR to Gln-Pro, Ala-Pro, or Asn-Ala. Antibodies with such substitutions are subsequently screened to ensure that the substitutions do not decrease the affinity or specificity of the antibody for LAG3, or other desired biological activity to unacceptable levels.

TABLE 3

Exemplary stabilizing CDR variants

| CDR Residue | Stabilizing Variant Sequence |
|---|---|
| Asn-Gly | Gln-Gly, Ala-Gly, or Asn-Ala |
| (N-G) | (Q-G), (A-G), or (N-A) |
| Asp-Gly | Glu-Gly, Ala-Gly or Asp-Ala |
| (D-G) | (E-G), (A-G), or (D-A) |
| Met (typically solvent exposed) | Lys, Leu, Ala, or Phe |
| (M) | (K), (L), (A), or (F) |
| Asn | Gln or Ala |
| (N) | (Q) or (A) |
| Asn-Pro | Gln-Pro, Ala-Pro, or Asn-Ala |
| (N-P) | (Q-P), (A-P), or (N-A) |

The immunoglobulin chains set forth above 4A10, 19E8, 11C9 and 22D2 contain residues that are double-underscored. The scope of the present invention includes antibodies, antigen-binding fragments, polypeptides and polynucleotides as discussed herein wherein any one or more of such residues are mutated to any other residue including, for example, those of the stabilizing variant sequences set forth above in Table 3.

Mouse anti-LAGS antibodies and antigen-binding fragments can be humanized by various methods known in the art (see e.g., humanization methods set forth in WO2005/047326 or U.S. Pat. No. 7,846,443.). For example, in an embodiment of the invention, mouse anti-LAG3 antibodies and fragments are humanized by a method wherein computer aided molecular modeling is used for identifying CDR loops in non-human immunoglobulin chains. This identification is made based upon the three-dimensional structure of the immunoglobulin chain and the position of the loops in the chain.

Human frameworks (obtained from the IMGD Database), into which the non-human loops will be introduced, are selected based on best matches (by amino acid sequence comparison) with the non-human sequence both in the frameworks and in the CDRs. Regarding the FR4 in the $V_H$ domain, VJ regions, for the human germlines, are compared with the corresponding non-human VJ regions; and, regarding FR4 in $V_L$ domain, J-kappa and J-Lambda regions, of human germline sequences, are compared with the corresponding non-human J-Kappa and J-Lambda regions.

Proper three-dimensional orientation of the CDRs, which is critical to maintaining antigen binding, depends, in part, on proper interfacing between the $V_H$ and $V_L$. Thus, the molecular models are constructed and used for identifying residues in the $V_L$-$V_H$ interface as well as for identifying residues that can potentially alter the CDR conformations and hence binding to antigen. If necessary, mutations in the immunoglobulin chain may be introduced so as to achieve desirable properties e.g., antigen binding.

Developability Filters are established through the use of molecular modeling techniques. Developability Filters are criteria used for filtering features out of the final immunoglobulin chain so as to avoid unwanted effects. Molecular models are further used to identify solvent exposed amino acids that can result in unwanted effects such as glycosylation, deamidation and oxidation. Such effects on the antibody can lead to changes in the antibody conformation and hence function. Such problems can occur, for example, during scale-up or over a prolonged period of time when exposed to extreme chemical/physical environments. Again, if necessary, mutations in the chains can be introduced so as achieve the desired properties.

The Developability Filters are typically introduced early on in the design stage of the humanized chains to eliminate/minimize these potential problems. Humanized antibodies are further subjected to design criteria, such as good expressibility and desirable isoelectric points.

Antibody Engineering of the Fc Region

The anti-LAG3 antibodies (e.g., humanized antibodies such as antagonist humanized antibodies) and antigen-binding fragments thereof disclosed herein (e.g., 4A10, 19E8, 11C9 and/or 22D2; e.g., Ab1, Ab2, Ab3, Ab4, Ab5, Ab6, Ab7, Ab8 and/or Ab9) may also be engineered to include modifications within the Fc region, typically to alter one or more functional properties of the antibody, such as serum half-life, complement fixation, Fc receptor binding, and/or effector function (e.g., antigen-dependent cellular cytotoxicity). Furthermore, the antibodies and antigen-binding fragments thereof (e.g., 4A10, 19E8, 11C9 and/or 22D2; e.g., Ab1, Ab2, Ab3, Ab4, Ab5, Ab6, Ab7, Ab8 and/or Ab9) can be chemically modified (e.g., one or more chemical moieties can be attached to the antibody) or be modified to alter its glycosylation, again to alter one or more functional properties of the antibody or fragment. Each of these embodiments is described in further detail below. The numbering of residues in the Fc region is that of the EU index of Kabat. Any such anti-LAG3 antibody or antigen-binding fragment thereof having the modifications (e.g., Fc modifications) and/or alterations discussed herein are part of the present invention.

The anti-LAG3 antibodies (e.g., humanized antibodies such as antagonist humanized antibodies) and antigen-binding fragments thereof disclosed herein (e.g., 4A10, 19E8, 11C9 and/or 22D2; e.g., Ab1, Ab2, Ab3, Ab4, Ab5, Ab6, Ab7, Ab8 and/or Ab9) also include antibodies and fragments with modified (or blocked) Fc regions to provide altered effector functions. See, e.g., U.S. Pat. No. 5,624,821; WO2003/086310; WO2005/120571; WO2006/0057702. Such modifications can be used to enhance or suppress various reactions of the immune system, with possible beneficial effects in diagnosis and therapy. Alterations of the Fc region include amino acid changes (substitutions, deletions and insertions), glycosylation or deglycosylation, and adding multiple Fc. Changes to the Fc can also alter the half-life of antibodies in therapeutic antibodies, enabling less frequent dosing and thus increased convenience and decreased use of material. See Presta (2005) *J. Allergy Clin. Immunol.* 116:731 at 734-35.

In one embodiment, the anti-LAG3 antibody (e.g., humanized antibodies such as antagonist humanized antibodies) or antigen-binding fragment (e.g., 4A10, 19E8, 11C9 and/or 22D2; e.g., Ab1, Ab2, Ab3, Ab4, Ab5, Ab6, Ab7, Ab8 and/or Ab9) is an IgG4 isotype antibody or fragment comprising a serine to proline mutation at a position corresponding to position 228 (S228P; EU index) in the hinge region of the heavy chain constant region. This mutation has been reported to abolish the heterogeneity of inter-heavy chain disulfide bridges in the hinge region (Angal et al. supra; position 241 is based on the Kabat numbering system).

In one embodiment of the invention, the hinge region of CH1 is modified such that the number of cysteine residues in the hinge region is increased or decreased. This approach is described further in U.S. Pat. No. 5,677,425. The number of cysteine residues in the hinge region of CH1 is altered, for example, to facilitate assembly of the light and heavy chains or to increase or decrease the stability of the antibody.

In another embodiment, the Fc hinge region of an anti-LAG3 antibody or antigen-binding fragment (e.g., 4A10, 19E8, 11C9 and/or 22D2; e.g., Ab1, Ab2, Ab3, Ab4, Ab5, Ab6, Ab7, Ab8 and/or Ab9) is mutated to decrease the biological half-life of the antibody or fragment. More specifically, one or more amino acid mutations are introduced into the CH2-CH3 domain interface region of the Fc-hinge fragment such that the antibody or fragment has impaired Staphylococcyl protein A (SpA) binding relative to native Fc-hinge domain SpA binding. This approach is described in further detail in U.S. Pat. No. 6,165,745.

In another embodiment, the anti-LAG3 antibody (e.g., humanized antibodies such as antagonist humanized antibodies) or antigen-binding fragment (e.g., 4A10, 19E8, 11C9 and/or 22D2; e.g., Ab1, Ab2, Ab3, Ab4, Ab5, Ab6, Ab7, Ab8 and/or Ab9) is modified to increase its biological half-life. Various approaches are possible. For example, one or more of the following mutations can be introduced: T252L, T254S, T256F, as described in U.S. Pat. No. 6,277,375. Alternatively, to increase the biological half-life, the antibody can be altered within the CH1 or CL region to contain a salvage receptor binding epitope taken from two loops of a CH2 domain of an Fc region of an IgG, as described in U.S. Pat. Nos. 5,869,046 and 6,121,022.

In yet other embodiments, the Fc region is altered by replacing at least one amino acid residue with a different amino acid residue to alter the effector function(s) of the anti-LAG3 antibody or antigen-binding fragment. For example, one or more amino acids selected from amino acid residues 234, 235, 236, 237, 297, 318, 320 and 322 can be replaced with a different amino acid residue such that the antibody has an altered affinity for an effector ligand but retains the antigen-binding ability of the parent antibody. The effector ligand to which affinity is altered can be, for example, an Fc receptor or the C1 component of complement. This approach is described in further detail in U.S. Pat. Nos. 5,624,821 and 5,648,260.

In another example, one or more amino acids selected from amino acid residues 329, 331 and 322 can be replaced with a different amino acid residue such that the anti-LAG3 antibody has altered C1q binding and/or reduced or abolished complement dependent cytotoxicity (CDC). This approach is described in further detail in U.S. Pat. No. 6,194,551.

In another example, one or more amino acid residues within amino acid positions 231 and 239 are altered to thereby alter the ability of the anti-LAG3 antibody or antigen-binding fragment thereof to fix complement. This approach is described further in PCT Publication WO 94/29351.

In yet another example, the Fc region is modified to decrease the ability of the anti-LAG3 antibody (e.g., humanized antibodies such as antagonist humanized antibodies) or antigen-binding fragment (e.g., 4A10, 19E8, 11C9 and/or 22D2; e.g., Ab1, Ab2, Ab3, Ab4, Ab5, Ab6, Ab7, Ab8 and/or Ab9) to mediate antibody dependent cellular cytotoxicity (ADCC) and/or to decrease the affinity of the antibody or fragment for an Fcγ receptor by modifying one or more amino acids at the following positions: 238, 239, 243, 248, 249, 252, 254, 255, 256, 258, 264, 265, 267, 268, 269, 270, 272, 276, 278, 280, 283, 285, 286, 289, 290, 292, 293, 294, 295, 296, 298, 301, 303, 305, 307, 309, 312, 315, 320, 322, 324, 326, 327, 329, 330, 331, 333, 334, 335, 337, 338, 340, 360, 373, 376, 378, 382, 388, 389, 398, 414, 416, 419, 430, 434, 435, 437, 438 or 439. This approach is described further in PCT Publication WO 00/42072. Moreover, the binding sites on human IgG1 for FcγRI, FcγRII, FcγRIII and FcRn have been mapped and variants with improved binding have been described (see Shields et al. (2001) *J. Biol. Chem.* 276:6591-6604).

In one embodiment of the invention, the Fc region is modified to decrease the ability of the anti-LAG3 antibody (e.g., humanized antibodies such as antagonist humanized antibodies) or antigen-binding fragment (e.g., 4A10, 19E8, 11C9 and/or 22D2; e.g., Ab1, Ab2, Ab3, Ab4, Ab5, Ab6, Ab7, Ab8 and/or Ab9) to mediate effector function and/or to increase anti-inflammatory properties by modifying residues 243 and 264. In one embodiment, the Fc region of the antibody or fragment is modified by changing the residues at positions 243 and 264 to alanine. In one embodiment, the Fc region is modified to decrease the ability of the antibody or fragment to mediate effector function and/or to increase anti-inflammatory properties by modifying residues 243, 264, 267 and 328.

In still another embodiment, the anti-LAG3 antibody (e.g., humanized antibodies such as antagonist humanized antibodies) or antigen-binding fragment (e.g., 4A10, 19E8, 11C9 and/or 22D2; e.g., Ab1, Ab2, Ab3, Ab4, Ab5, Ab6, Ab7, Ab8 and/or Ab9) comprises a particular glycosylation pattern. For example, an aglycosylated antibody or fragment can be made (i.e., the antibody lacks glycosylation). The glycosylation pattern of an antibody or fragment may be altered to, for example, increase the affinity or avidity of the antibody or fragment for a LAG3 antigen. Such modifications can be accomplished by, for example, altering one or more of the glycosylation sites within the antibody or fragment sequence. For example, one or more amino acid substitutions can be made that result removal of one or more of the variable region framework glycosylation sites to thereby eliminate glycosylation at that site. Such aglycosylation may increase the affinity or avidity of the antibody or fragment for antigen. See, e.g., U.S. Pat. Nos. 5,714,350 and 6,350,861.

Anti-LAG3 antibodies (e.g., humanized antibodies such as antagonist humanized antibodies) and antigen-binding fragments disclosed herein (e.g., 4A10, 19E8, 11C9 and/or 22D2; e.g., Ab1, Ab2, Ab3, Ab4, Ab5, Ab6, Ab7, Ab8 and/or Ab9) include those produced in lower eukaryote host cells, in particular fungal host cells such as yeast (e.g., *Pichia pastoris*) and filamentous fungi, that have been genetically engineered to produce glycoproteins that have mammalian- or human-like glycosylation patterns (See for example, Choi et al, (2003) *Proc. Natl. Acad. Sci.* 100: 5022-5027; Hamilton et al., (2003) *Science* 301: 1244-1246; Hamilton et al., (2006) *Science* 313: 1441-1443). A particular advantage of these genetically modified host cells over currently used mammalian cell lines is the ability to control the glycosylation profile of glycoproteins that are produced in the cells such that compositions of glycoproteins can be produced wherein a particular N-glycan structure predominates (see, e.g., U.S. Pat. No. 7,029,872 and U.S. Pat. No. 7,449,308). These genetically modified host cells have been used to produce antibodies that have predominantly particular N-glycan structures (See for example, Li et al., (2006) *Nat. Biotechnol.* 24: 210-215).

In particular embodiments, the anti-LAG3 antibodies (e.g., humanized antibodies such as antagonist humanized antibodies) and antigen-binding fragments thereof disclosed herein (e.g., 4A10, 19E8, 11C9 and/or 22D2; e.g., Ab1, Ab2, Ab3, Ab4, Ab5, Ab6, Ab7, Ab8 and/or Ab9) further include those produced in lower eukaryotic host cells and which comprise fucosylated and non-fucosylated hybrid and complex N-glycans, including bisected and multiantennary species, including but not limited to N-glycans such as $GlcNAc_{(1-4)}Man_3GlcNAc_2$; $Gal_{(1-4)}GlcNAc_{(1-4)}Man_3GlcNAc_2$; $NANA_{(1-4)}Gal_{(1-4)}GlcNAc_{(1-4)}Man_3GlcNAc_2$.

In particular embodiments, the anti-LAG3 antibodies (e.g., humanized antibodies such as antagonist humanized antibodies) and antigen-binding fragments thereof provided herein (e.g., 4A10, 19E8, 11C9 and/or 22D2; e.g., Ab1, Ab2, Ab3, Ab4, Ab5, Ab6, Ab7, Ab8 and/or Ab9) may comprise antibodies or fragments having at least one hybrid N-glycan selected from the group consisting of $GlcNAcMan_5GlcNAc_2$; $GalGlcNAcMan_5GlcNAc_2$; and $NANAGalGlcNAcMan_5GlcNAc_2$. In particular aspects, the hybrid N-glycan is the predominant N-glycan species in the composition. In further aspects, the hybrid N-glycan is a particular N-glycan species that comprises about 30%, 40%, 50%, 60%, 70%, 80%, 90%, 95%, 97%, 98%, 99%, or 100% of the hybrid N-glycans in the composition.

In particular embodiments, the anti-LAG3 antibodies (e.g., humanized antibodies such as antagonist humanized antibodies) and antigen-binding fragments thereof provided herein (e.g., 4A10, 19E8, 11C9 and/or 22D2; e.g., Ab1, Ab2, Ab3, Ab4, Ab5, Ab6, Ab7, Ab8 and/or Ab9) comprise antibodies and fragments having at least one complex N-glycan selected from the group consisting of $GlcNAcMan_3GlcNAc_2$; $GalGlcNAcMan_3GlcNAc_2$; $NANAGalGlcNAcMan_3GlcNAc_2$; $GlcNAc_2Man_3GlcNAc_2$; $GalGlcNAc_2Man_3GlcNAc_2$; $Gal_2GlcNAc_2Man_3GlcNAc_2$; $NANAGal_2GlcNAc_2Man_3GlcNAc_2$; and $NANA_2Gal_2GlcNAc_2Man_3GlcNAc_2$. In particular aspects, the complex N-glycan is the predominant N-glycan species in the composition. In further aspects, the complex N-glycan is a particular N-glycan species that comprises about 30%, 40%, 50%, 60%, 70%, 80%, 90%, 95%, 97%, 98%, 99%, or 100% of the complex N-glycans in the composition.

In particular embodiments, the anti-LAG3 antibody and antigen-binding fragment N-glycan is fucosylated. In general, the fucose is in an α1,3-linkage with the GlcNAc at the reducing end of the N-glycan, an α1,6-linkage with the GlcNAc at the reducing end of the N-glycan, an α1,2-linkage with the Gal at the non-reducing end of the N-glycan, an α1,3-linkage with the GlcNac at the non-reducing end of the N-glycan, or an α1,4-linkage with a GlcNAc at the non-reducing end of the N-glycan.

Therefore, in particular aspects of the above the glycoprotein compositions, the glycoform is in an α1,3-linkage or α1,6-linkage fucose to produce a glycoform selected from the group consisting of $Man_5GlcNAc_2(Fuc)$, $GlcNAcMan_5GlcNAc_2(Fuc)$, $Man_3GlcNAc_2(Fuc)$, $GlcNAcMan_3GlcNAc_2(Fuc)$, $GlcNAc_2Man_3GlcNAc_2(Fuc)$, $GalGlcNAc_2Man_3GlcNAc_2(Fuc)$, $Gal_2GlcNAc_2Man_3GlcNAc_2(Fuc)$, $NANAGal_2GlcNAc_2Man_3GlcNAc_2(Fuc)$, and $NANA_2Gal_2GlcNAc_2Man_3GlcNAc_2(Fuc)$; in an α1,3-linkage or α1,4-linkage fucose to produce a glycoform selected from the group consisting of $GlcNAc(Fuc)Man_5GlcNAc_2$, $GlcNAc(Fuc)Man_3GlcNAc_2$, $GlcNAc_2(Fuc_{1-2})Man_3GlcNAc_2$, $GalGlcNAc_2(Fuc_{1-2})Man_3GlcNAc_2$, $Gal_2GlcNAc_2(Fuc_{1-2})Man_3GlcNAc_2$, $NANAGal_2GlcNAc_2(Fuc_{1-2})Man_3GlcNAc_2$, and $NANA_2Gal_2GlcNAc_2(Fuc_{1-2})Man_3GlcNAc_2$; or in an α1,2-linkage fucose to produce a glycoform selected from the group consisting of $Gal(Fuc)GlcNAc_2Man_3GlcNAc_2$, $Gal_2(Fuc_{1-2})GlcNAc_2Man_3GlcNAc_2$, $NANAGal_2(Fuc_{1-2})GlcNAc_2Man_3GlcNAc_2$, and $NANA_2Gal_2(Fuc_{1-2})GlcNAc_2Man_3GlcNAc_2$.

In further aspects, the anti-LAG3 antibodies (e.g., humanized antibodies such as antagonist humanized antibodies) or antigen-binding fragments thereof comprise high mannose N-glycans, including but not limited to, $Man_8GlcNAc_2$, $Man_7GlcNAc_2$, $Man_6GlcNAc_2$, $Man_5GlcNAc_2$, $Man_4GlcNAc_2$, or N-glycans that consist of the $Man_3GlcNAc_2$ N-glycan structure.

In further aspects of the above, the complex N-glycans further include fucosylated and non-fucosylated bisected and multiantennary species.

In an embodiment of the invention, an anti-LAG3 antibody or antigen-binding fragment thereof (e.g., Ab1, Ab2, Ab3, Ab4, Ab5, Ab6, Ab7, Ab8 or Ab9) comprises an immunoglobulin Fc domain that comprises glycans that comprise sialic acid (e.g., N-Acetylneuraminic acid), e.g., terminal α2,3-sialic acid or terminal α2,6-sialic acid. In an embodiment of the invention, the glycans on the Fc are 5, 10, 20, 50, 90% or more sialylated species. In an embodiment of the invention, the Fc comprises the mutations at positions 297, 264 and/or 243.

As used herein, the terms "N-glycan" and "glycoform" are used interchangeably and refer to an N-linked oligosaccharide, for example, one that is attached by an asparagine-N-acetylglucosamine linkage to an asparagine residue of a polypeptide. N-linked glycoproteins contain an N-acetylglucosamine residue linked to the amide nitrogen of an asparagine residue in the protein. The predominant sugars found on glycoproteins are glucose, galactose, mannose, fucose, N-acetylgalactosamine (GalNAc), N-acetylglucosamine (GlcNAc) and sialic acid (e.g., N-acetylneuraminic acid (NANA)). The processing of the sugar groups occurs co-translationally in the lumen of the ER and continues post-translationally in the Golgi apparatus for N-linked glycoproteins.

N-glycans have a common pentasaccharide core of $Man_3GlcNAc_2$ ("Man" refers to mannose; "Glc" refers to glucose; and "NAc" refers to N-acetyl; GlcNAc refers to N-acetylglucosamine). Usually, N-glycan structures are presented with the non-reducing end to the left and the reducing end to the right. The reducing end of the N-glycan is the end that is attached to the Asn residue comprising the glycosylation site on the protein. N-glycans differ with respect to the number of branches (antennae) comprising peripheral sugars (e.g., GlcNAc, galactose, fucose and sialic acid) that are added to the $Man_3GlcNAc_2$ ("Man3") core structure which is also referred to as the "trimannose core", the "pentasaccharide core" or the "paucimannose core". N-glycans are classified according to their branched constituents (e.g., high mannose, complex or hybrid). A "high mannose" type N-glycan has five or more mannose residues. A "complex" type N-glycan typically has at least one GlcNAc attached to the 1,3 mannose arm and at least one GlcNAc attached to the 1,6 mannose arm of a "trimannose" core. Complex N-glycans may also have galactose ("Gal") or N-acetylgalactosamine ("GalNAc") residues that are optionally modified with sialic acid or derivatives (e.g., "NANA" or "NeuAc", where "Neu" refers to neuraminic acid and "Ac" refers to acetyl). Complex N-glycans may also have intrachain substitutions comprising "bisecting" GlcNAc and core fucose ("Fuc"). Complex N-glycans may also have multiple antennae on the "trimannose core," often referred to as "multiple antennary glycans." A "hybrid" N-glycan has at least one GlcNAc on the terminal of the 1,3 mannose arm of the trimannose core and zero or more mannoses on the 1,6 mannose arm of the trimannose core. The various N-glycans are also referred to as "glycoforms."

With respect to complex N-glycans, the terms "G-2", "G-1", "G0", "G1", "G2", "A1", and "A2" mean the following. "G-2" refers to an N-glycan structure that can be characterized as $Man_3GlcNAc_2$; the term "G-1" refers to an N-glycan structure that can be characterized as $GlcNAcMan_3GlcNAc_2$; the term "G0" refers to an N-glycan structure that can be characterized as $GlcNAc_2Man_3GlcNAc_2$; the term "G1" refers to an N-glycan structure that can be characterized as $GalGlcNAc_2Man_3GlcNAc_2$; the term "G2" refers to an N-glycan structure that can be characterized as $Gal_2GlcNAc_2Man_3GlcNAc_2$; the term "A1" refers to an N-glycan structure that can be characterized as $NANAGal_2GlcNAc_2Man_3GlcNAc_2$; and, the term "A2" refers to an N-glycan structure that can be characterized as $NANA_2Gal_2GlcNAc_2Man_3GlcNAc_2$. Unless otherwise indicated, the terms G-2", "G-1", "G0", "G1", "G2", "A1", and "A2" refer to N-glycan species that lack fucose attached to the GlcNAc residue at the reducing end of the N-glycan. When the term includes an "F", the "F" indicates that the N-glycan species contains a fucose residue on the GlcNAc residue at the reducing end of the N-glycan. For example, G0F, G1F, G2F, A1F, and A2F all indicate that the N-glycan further includes a fucose residue attached to the GlcNAc residue at the reducing end of the N-glycan. Lower eukaryotes such as yeast and filamentous fungi do not normally produce N-glycans that produce fucose.

With respect to multiantennary N-glycans, the term "multiantennary N-glycan" refers to N-glycans that further comprise a GlcNAc residue on the mannose residue comprising the non-reducing end of the 1,6 arm or the 1,3 arm of the N-glycan or a GlcNAc residue on each of the mannose residues comprising the non-reducing end of the 1,6 arm and the 1,3 arm of the N-glycan. Thus, multiantennary N-glycans can be characterized by the formulas $GlcNAc_{(2-4)}$ Man$_3$GlcNAc$_2$, Gal$_{(1-4)}$GlcNAc$_{(2-4)}$Man$_3$GlcNAc$_2$, or NANA$_{(1-4)}$Gal$_{(1-4)}$GlcNAc$_{(2-4)}$Man$_3$GlcNAc$_2$. The term "1-4" refers to 1, 2, 3, or 4 residues.

With respect to bisected N-glycans, the term "bisected N-glycan" refers to N-glycans in which a GlcNAc residue is linked to the mannose residue at the reducing end of the N-glycan. A bisected N-glycan can be characterized by the formula GlcNAc$_3$Man$_3$GlcNAc$_2$ wherein each mannose residue is linked at its non-reducing end to a GlcNAc residue. In contrast, when a multiantennary N-glycan is characterized as GlcNAc$_3$Man$_3$GlcNAc$_2$, the formula indicates that two GlcNAc residues are linked to the mannose residue at the non-reducing end of one of the two arms of the N-glycans and one GlcNAc residue is linked to the mannose residue at the non-reducing end of the other arm of the N-glycan.

Antibody Physical Properties

The anti-LAG3 antibodies (e.g., humanized antibodies such as antagonist humanized antibodies) and antigen-binding fragments thereof disclosed herein (e.g., 4A10, 19E8, 11C9 and/or 22D2; e.g., Ab1, Ab2, Ab3, Ab4, Ab5, Ab6, Ab7, Ab8 and/or Ab9) may further contain one or more glycosylation sites in either the light or heavy chain immunoglobulin variable region. Such glycosylation sites may result in increased immunogenicity of the antibody or fragment or an alteration of the pK of the antibody due to altered antigen-binding (Marshall et al. (1972) *Annu Rev Biochem* 41:673-702; Gala and Morrison (2004) *J Immunol* 172: 5489-94; Wallick et al (1988) *J Exp Med* 168:1099-109; Spiro (2002) *Glycobiology* 12:43R-56R; Parekh et al (1985) *Nature* 316:452-7; Mimura et al. (2000) *Mol Immunol* 37:697-706). Glycosylation has been known to occur at motifs containing an N-X-S/T sequence.

Each anti-LAG3 antibody (e.g., humanized antibodies such as antagonist humanized antibodies) or antigen-binding fragment (e.g., 4A10, 19E8, 11C9 and/or 22D2; e.g., Ab1, Ab2, Ab3, Ab4, Ab5, Ab6, Ab7, Ab8 and/or Ab9) will have a unique isoelectric point (pI). For example, some antibodies, such as Ab6, have a pI of about 6.3.

Each anti-LAG3 antibody (e.g., humanized antibodies such as antagonist humanized antibodies) or antigen-binding fragment (e.g., 4A10, 19E8, 11C9 and/or 22D2; e.g., Ab1, Ab2, Ab3, Ab4, Ab5, Ab6, Ab7, Ab8 and/or Ab9) will have a characteristic melting temperature, with a higher melting temperature indicating greater overall stability in vivo (Krishnamurthy R and Manning M C (2002) *Curr Pharm Biotechnol* 3:361-71). In general, the T$_{M1}$ (the temperature of initial unfolding) may be greater than 60° C., greater than 65° C., or greater than 70° C. The melting point of an antibody or fragment can be measured using differential scanning calorimetry (Chen et al (2003) *Pharm Res* 20:1952-60; Ghirlando et al (1999) *Immunol Lett* 68:47-52) or circular dichroism (Murray et al. (2002) *J. Chromatogr Sci* 40:343-9).

In a further embodiment, anti-LAG3 antibodies (e.g., humanized antibodies such as antagonist humanized antibodies) and antigen-binding fragments thereof (e.g., 4A10, 19E8, 11C9 and/or 22D2; e.g., Ab1, Ab2, Ab3, Ab4, Ab5, Ab6, Ab7, Ab8 and/or Ab9) are selected that do not degrade rapidly. Degradation of an antibody or fragment can be measured using capillary electrophoresis (CE) and MALDI-MS (Alexander A J and Hughes D E (1995) *Anal Chem* 67:3626-32).

In a further embodiment, anti-LAG3 antibodies (e.g., humanized antibodies such as antagonist humanized antibodies) and antigen-binding fragments thereof are selected that have minimal aggregation effects, which can lead to the triggering of an unwanted immune response and/or altered or unfavorable pharmacokinetic properties. Generally, antibodies and fragments are acceptable with aggregation of 25% or less, 20% or less, 15% or less, 10% or less, or 5% or less. Aggregation can be measured by several techniques, including size-exclusion column (SEC), high performance liquid chromatography (HPLC), and light scattering.

Antibody Conjugates

The anti-LAG3 antibodies (e.g., humanized antibodies such as antagonist humanized antibodies) and antigen-binding fragments thereof disclosed herein (e.g., 4A10, 19E8, 11C9 and/or 22D2; e.g., Ab1, Ab2, Ab3, Ab4, Ab5, Ab6, Ab7, Ab8 and/or Ab9) may also be conjugated to a chemical moiety. Such conjugated antibodies and fragments are part of the present invention. The chemical moiety may be, inter alia, a polymer, a radionuclide or a cytotoxic factor. In particular embodiments, the chemical moiety is a polymer which increases the half-life of the antibody or fragment in the body of a subject. Suitable polymers include, but are not limited to, hydrophilic polymers which include but are not limited to polyethylene glycol (PEG) (e.g., PEG with a molecular weight of 2 kDa, 5 kDa, 10 kDa, 12 kDa, 20 kDa, 30 kDa or 40 kDa), dextran and monomethoxypolyethylene glycol (mPEG). Lee, et al., (1999) (*Bioconj. Chem.* 10:973-981) discloses PEG conjugated single-chain antibodies. Wen, et al., (2001) (*Bioconj. Chem.* 12:545-553) disclose conjugating antibodies with PEG which is attached to a radiometal chelator (diethylenetriaminpentaacetic acid (DTPA)).

The anti-LAG3 antibodies (e.g., humanized antibodies such as antagonist humanized antibodies) and antigen-binding fragments thereof disclosed herein (e.g., 4A10, 19E8, 11C9 and/or 22D2; e.g., Ab1, Ab2, Ab3, Ab4, Ab5, Ab6, Ab7, Ab8 and/or Ab9) may also be conjugated with labels such as $^{99}$Tc, $^{90}$Y, $^{111}$In, $^{32}$P, $^{14}$C, $^{125}$I, $^{3}$H, $^{131}$I, $^{11}$C, $^{15}$O, $^{13}$N, $^{18}$F, $^{35}$S, $^{51}$Cr, $^{57}$To, $^{226}$Ra, $^{60}$Co, $^{59}$Fe, $^{57}$Se, $^{152}$Eu, $^{67}$CU, $^{217}$Ci, $^{211}$At, $^{212}$Pb, $^{47}$Sc, $^{109}$Pd, $^{234}$Th, and $^{40}$K, $^{157}$Gd, $^{55}$Mn, $^{52}$Tr, and $^{56}$Fe.

The anti-LAG3 antibodies (e.g., humanized antibodies such as antagonist humanized antibodies) and antigen-binding fragments disclosed herein (e.g., 4A10, 19E8, 11C9 and/or 22D2; e.g., Ab1, Ab2, Ab3, Ab4, Ab5, Ab6, Ab7, Ab8 and/or Ab9) may also be PEGylated, for example to increase its biological (e.g., serum) half-life. To PEGylate an antibody or fragment, the antibody or fragment, typically is reacted with a reactive form of polyethylene glycol (PEG), such as a reactive ester or aldehyde derivative of PEG, under conditions in which one or more PEG groups become attached to the antibody or antibody fragment. In particular embodiments, the PEGylation is carried out via an acylation reaction or an alkylation reaction with a reactive PEG molecule (or an analogous reactive water-soluble polymer). As used herein, the term "polyethylene glycol" is intended to encompass any of the forms of PEG that have been used to derivatize other proteins, such as mono (C1-C10) alkoxy- or aryloxy-polyethylene glycol or polyethylene glycol-maleimide. In certain embodiments, the antibody or fragment to be PEGylated is an aglycosylated antibody or fragment. Methods for PEGylating proteins are known in the art and can be applied to the antibodies of the invention. See, e.g., EP 0 154 316 and EP 0 401 384.

The anti-LAG3 antibodies (e.g., humanized antibodies such as antagonist humanized antibodies) and antigen-binding fragments disclosed herein (e.g., 4A10, 19E8, 11C9 and/or 22D2; e.g., Ab1, Ab2, Ab3, Ab4, Ab5, Ab6, Ab7, Ab8 and/or Ab9) may also be conjugated with fluorescent or chemiluminescent labels, including fluorophores such as rare earth chelates, fluorescein and its derivatives, rhodamine and its derivatives, isothiocyanate, phycoerythrin, phycocyanin, allophycocyanin, o-phthaladehyde, fluorescamine, $^{152}$Eu, dansyl, umbelliferone, luciferin, luminal label, isoluminal label, an aromatic acridinium ester label, an imidazole label, an acridimium salt label, an oxalate ester label, an aequorin label, 2,3-dihydrophthalazinediones, biotin/avidin, spin labels and stable free radicals.

The anti-LAG3 antibodies (e.g., humanized antibodies such as antagonist humanized antibodies) and antigen-binding fragments thereof (e.g., 4A10, 19E8, 11C9 and/or 22D2; e.g., Ab1, Ab2, Ab3, Ab4, Ab5, Ab6, Ab7, Ab8 and/or Ab9) may also be conjugated to a cytotoxic factor such as diptheria toxin, *Pseudomonas aeruginosa* exotoxin A chain, ricin A chain, abrin A chain, modeccin A chain, alpha-sarcin, *Aleurites fordii* proteins and compounds (e.g., fatty acids), dianthin proteins, *Phytoiacca americana* proteins PAPI, PAPII, and PAP-S, *momordica charantia* inhibitor, curcin, crotin, *saponaria officinalis* inhibitor, mitogellin, restrictocin, phenomycin, and enomycin.

Any method known in the art for conjugating the anti-LAG3 antibodies (e.g., humanized antibodies such as antagonist humanized antibodies) and antigen-binding fragments thereof (e.g., 4A10, 19E8, 11C9 and/or 22D2; e.g., Ab1, Ab2, Ab3, Ab4, Ab5, Ab6, Ab7, Ab8 and/or Ab9) to the various moieties may be employed, including those methods described by Hunter, et al., (1962) *Nature* 144:945; David, et al., (1974) Biochemistry 13:1014; Pain, et al., (1981) J. Immunol. Meth. 40:219; and Nygren, J., (1982) *Histochem. and Cytochem.* 30:407. Methods for conjugating antibodies and fragments are conventional and very well known in the art.

Therapeutic Uses of Anti-LAG3 Antibodies

Further provided are methods for treating or preventing cancer in subjects, such as human subjects, in need of such treatment by administering an effective amount of the anti-LAG3 antibodies or antigen-binding fragments thereof of the present invention which are disclosed herein (e.g., 4A10, 19E8, 11C9 and/or 22D2; e.g., Ab1, Ab2, Ab3, Ab4, Ab5, Ab6, Ab7, Ab8 and/or Ab9) which may be effective for such treatment or prevention. In an embodiment of the invention, such a subject suffers from and is treated for cancer, e.g., a solid tumor which includes, in addition to the tumor cells, tumor infiltrating lymphocytes (TILs), such as T-cells, expressing LAG3, e.g., osteosarcoma, rhabdomyosarcoma, neuroblastoma, kidney cancer, leukemia, renal transitional cell cancer, bladder cancer, Wilm's cancer, ovarian cancer, pancreatic cancer, breast cancer (e.g., characterized by a mutation in BRCA1 and/or BRCA2), prostate cancer, bone cancer, lung cancer (e.g., non-small cell lung cancer), gastric cancer, colorectal cancer, cervical cancer, synovial sarcoma, head and neck cancer, squamous cell carcinoma, multiple myeloma, renal cell cancer, retinoblastoma, hepatoblastoma, hepatocellular carcinoma, melanoma, rhabdoid tumor of the kidney, Ewing's sarcoma, chondrosarcoma, brain cancer, glioblastoma, meningioma, pituitary adenoma, vestibular schwannoma, a primitive neuroectodermal tumor, medulloblastoma, astrocytoma, anaplastic astrocytoma, oligodendroglioma, ependymoma, choroid plexus papilloma, polycythemia vera, thrombocythemia, idiopathic myelfibrosis, soft tissue sarcoma, thyroid cancer, endometrial cancer, carcinoid cancer or liver cancer, breast cancer or gastric cancer. In an embodiment of the invention, the cancer is metastatic cancer, e.g., of the varieties described above.

The present invention also provides methods for treating or preventing an infectious disease in a subject by administering an effective amount of anti-LAG3 antibodies or antigen-binding fragments thereof disclosed herein (e.g., 4A10, 19E8, 11C9 and/or 22D2; e.g., Ab1, Ab2, Ab3, Ab4, Ab5, Ab6, Ab7, Ab8 and/or Ab9) to the subject which may be effective for such treatment or prevention. In an embodiment of the invention, the infectious disease is viral infection. In an embodiment of the invention, the infectious disease is bacterial infection. In an embodiment of the invention, the infectious disease is parasitic infection. In an embodiment of the invention, the infectious disease is fungal infection.

The present invention includes methods of treating any of the cancers or infectious diseases discussed herein by administering a therapeutically effective amount of an anti-LAG3 antibody or antigen-binding fragment thereof (e.g., 4A10, 19E8, 11C9 and/or 22D2; e.g., Ab1, Ab2, Ab3, Ab4, Ab5, Ab6, Ab7, Ab8 and/or Ab9) optionally in association with any of the further chemotherapeutic agents or therapeutic procedures discussed herein as well as compositions including such an antibody or fragment in association with such a further chemotherapeutic agent.

In an embodiment of the invention, the viral infection is infection with a virus selected from the group consisting of human immunodeficiency virus (HIV), ebola virus, hepatitis virus (A, B, or C), herpes virus (e.g., VZV, HSV-I, HAV-6, HSV-II, and CMV, Epstein Barr virus), adenovirus, influenza virus, flaviviruses, echovirus, rhinovirus, coxsackie virus, coronavirus, respiratory syncytial virus, mumps virus, rotavirus, measles virus, rubella virus, parvovirus, vaccinia virus, HTLV virus, dengue virus, papillomavirus, molluscum virus, poliovirus, rabies virus, JC virus or arboviral encephalitis virus.

In an embodiment of the invention, the bacterial infection is infection with a bacteria selected from the group consisting of *Chlamydia*, rickettsial bacteria, mycobacteria, staphylococci, streptococci, pneumonococci, meningococci and gonococci, *klebsiella, proteus, serratia, pseudomonas, Legionella, Corynebacterium diphtheriae, Salmonella,* bacilli, *Vibrio cholerae, Clostridium tetan, Clostridium botulinum, Bacillus anthricis, Yersinia pestis, Mycobacterium leprae, Mycobacterium lepromatosis,* and *Borriella*.

In an embodiment of the invention, the fungal infection is infection with a fungus selected from the group consisting of *Candida (albicans, krusei, glabrata, tropicalis,* etc.), *Cryptococcus neoformans, Aspergillus (fumigatus, niger,* etc.), Genus *Mucorales (mucor, absidia, rhizopus), Sporothrix schenkii, Blastomyces dermatitidis, Paracoccidioides brasiliensis, Coccidioides immitis* and *Histoplasma capsulatum*.

In an embodiment of the invention, the parasitic infection is infection with a parasite selected from the group consisting of *Entamoeba histolytica, Balantidium coli, Naegleria fowleri, Acanthamoeba, Giardia lambia, Cryptosporidium, Pneumocystis carinii, Plasmodium vivax, Babesia microti, Trypanosoma brucei, Trypanosoma cruzi, Leishmania donovani, Toxoplasma gondii, Nippostrongylus brasiliensis*.

In addition, the present invention provides a method for preventing or inhibiting LAG3 binding to MHC class II, enhancing antigen-specific T-cell activation or stimulating T-cell production of interleukin-2 in a subject (e.g., human), for example, wherein the subject suffers from cancer or infectious disease (e.g., as discussed herein) comprising administering an effective amount of anti-LAG3 antibody or antigen-binding fragment thereof (e.g., 4A10, 19E8, 11C9, 22D2, Ab1, Ab2, Ab3, Ab4, Ab5, Ab6, Ab7, Ab8 and/or Ab9, to the subject, optionally, in association with a further chemotherapeutic agent, e.g., pembrolizumab or nivolumab.

The scope of the present invention provides uses of the anti-LAG3 antibodies or antigen-binding fragments thereof disclosed herein (e.g., 4A10, 19E8, 11C9 and/or 22D2; e.g., Ab1, Ab2, Ab3, Ab4, Ab5, Ab6, Ab7, Ab8 and/or Ab9) in the manufacture of a medicament for treating cancer or infectious disease in a subject.

The present invention includes methods for treating or preventing osteosarcoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing rhabdomyo sarcoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing neuroblastoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing kidney cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing leukemia comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing renal transitional cell cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing bladder cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing Wilm's cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing ovarian cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing pancreatic cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing breast cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. In an embodiment of the invention, the method for treating or preventing breast cancer comprises administering an effective amount of an anti-LAG3 antibody or antigen-binding fragment thereof of the present invention in association with an anthracycline (e.g., doxorubicin and/or epirubicin) and/or a taxane (e.g., paclitaxel and/or docetaxel). Optionally, an anthracycline and taxane is in association with 5-fluorouracil (5-FU), cyclophosphamide, and carboplatin. In an embodiment of the invention, wherein the breast cancer is HER2 positive, the anti-LAG3 antibody or fragment is administered in association with trastuzumab, optionally with a taxane and/or pertuzumab.

The present invention includes methods for treating or preventing prostate cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing bone cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing lung cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. In an embodiment of the invention, the method for treating or preventing lung cancer comprises administering an effective amount of an anti-LAG3 antibody or antigen-binding fragment thereof of the present invention in association with bevacizumab and/or cetuximab.

The present invention includes methods for treating or preventing non-small cell lung cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. In an embodiment of the invention, the method for treating or preventing non-small cell lung cancer comprises administering an effective amount of an anti-LAG3 antibody or antigen-binding fragment thereof of the present invention in association with cisplatin, carboplatin, paclitaxel, albumin-bound paclitaxel, docetaxel, gemcitabine, vinorelbine, irinotecan, etoposide, vinblastine, and/or pemetrexed.

The present invention includes methods for treating or preventing gastric cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing colorectal cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. In an embodiment of the invention, the method for treating or preventing colorectal cancer comprises administering an effective amount of an anti-LAG3 antibody or antigen-binding fragment thereof of the present invention in association with 5-Fluorouracil (5-FU), capecitabine, irinotecan and/or oxaliplatin (e.g., FOLFOX, FOLFIRI, FOLFOXIRI or CapeOx).

The present invention includes methods for treating or preventing cervical cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing synovial sarcoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing head and neck cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing squamous cell carcinoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing multiple myeloma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing renal cell cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing retinoblastoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing hepatoblastoma comprising administering (optionally in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing hepatocellular carcinoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing melanoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing rhabdoid tumor of the kidney comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing Ewing's sarcoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing chondrosarcoma comprising administering (optionally in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing brain cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing glioblastoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. In an embodiment of the invention, the method for treating or preventing glioblastoma multiforme comprises administering an effective amount of an anti-LAG3 antibody or antigen-binding fragment thereof of the present invention in association with temozolomide.

The present invention includes methods for treating or preventing meningioma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing pituitary adenoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing vestibular schwannoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing a primitive neuroectodermal tumor comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing medulloblastoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing astrocytoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing anaplastic astrocytoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. In an embodiment of the invention, the method for treating or preventing refractory anaplastic astrocytoma comprises administering an effective amount of an anti-LAG3 antibody or antigen-binding fragment thereof of the present invention in association with temozolomide.

The present invention includes methods for treating or preventing oligodendroglioma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing ependymoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing choroid plexus papilloma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing polycythemia vera comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing thrombocythemia comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing idiopathic myelfibrosis comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing soft tissue sarcoma comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing thyroid cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing endometrial cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing carcinoid cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing liver cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing breast cancer (e.g., characterized by a mutation in BRCA1 and/or BRCA2) comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing gastric cancer comprising administering (optionally, in association with pembrolizumab or nivolumab) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing an infection with human immunodeficiency virus (HIV) in a subject comprising administering) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent such as a protease inhibitor, a nucleoside/nucleotide reverse transcriptase inhibitor, a non-nucleoside reverse transcriptase inhibitors, an entry inhibitor, a fusion inhibitor or an integrase inhibitors.

The present invention includes methods for treating or preventing an infection with Bundibugyo virus (BDBV), Sudan virus (SUDV), Taï Forest virus (TAFV) and/or ebola virus in a subject comprising administering) an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent, such as one or more antibodies that specifically bind to the BDBV, SUDV, TAFV or ebola virus or a nucleoside RNA polymerase inhibitor; or a vaccine.

The present invention includes methods for treating or preventing an infection with hepatitis A virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with hepatitis B virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with hepatitis C virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent such as interferon and/or ribavirin.

The present invention includes methods for treating or preventing an infection with herpes virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with vesicular stomatitis virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with herpes simplex virus-I in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9)

to a subject, such as a human, in need thereof. Optionally, the subject is administered an anti-viral therapeutic agent.

The present invention includes methods for treating or preventing an infection with HAV-6 virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with herpes simplex virus-II in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with cytomegalovirus (CMV) in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with epstein Barr virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with adenovirus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with influenza virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with flavivirus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with echovirus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with rhinovirus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with coxsackie virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with coronavirus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with respiratory syncytial virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with mumps virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with rotavirus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with measles virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with rubella virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with parvovirus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with vaccinia virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with human T-lymphotropic virus (HTLV) in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with dengue virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with papillomavirus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with molluscum virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with poliovirus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with rabies virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with John Cunningham virus (JC virus) in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with arboviral encephalitis virus in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-viral therapeutic agent.

The present invention includes methods for treating or preventing an infection with *Chlamydia trachomatis* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *rickettsia* bacteria in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with mycobacteria in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with staphylococci in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with streptococci in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with pneumonococci in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with meningococci in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with gonococci in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *klebsiella* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *proteus* (e.g., *P. vulgaris, P. mirabilis*, or *P. penneri*) in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *serratia* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *pseudomonas* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *legionella* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *Corynebacterium diphtheriae* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *Salmonella* (e.g., *Salmonella bongori* or *Salmonella enterica*) in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with bacilli in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *Vibrio cholerae* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *Clostridium tetani* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *Clostridium botulinum* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *Bacillus anthracis* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *Yersinia pestis* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *Leptospira* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *Borrelia* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-bacterial antibiotic.

The present invention includes methods for treating or preventing an infection with *Candida albicans* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Candida krusei* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Candida glabrata* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Candida tropicalis* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Cryptococcus neoformans* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Aspergillus fumigatus* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Aspergillus niger* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Mucorales mucor* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Mucorales absidia* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Mucorales rhizopus* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Sporothrix schenkii* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Blastomyces dermatitidis* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Paracoccidioides brasiliensis* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Coccidioides immitis* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Histoplasma capsulatum* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof. Optionally, the subject is administered an anti-fungal therapeutic agent.

The present invention includes methods for treating or preventing an infection with *Entamoeba histolytica* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing an infection with *Balantidium coli* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing an infection with *Naegleria fowleri* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing an infection with *Acanthamoeba* sp. in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing an infection with *Giardia lambia* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing an infection with *Cryptosporidium* sp. in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing an infection with *Pneumocystis carinii* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing an infection with *Plasmodium vivax* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing an infection with *Babesia microti* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing an infection with *Trypanosoma brucei* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing an infection with *Trypanosoma cruzi* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing an infection with *Leishmania donovani* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing an infection with *Toxoplasma gondii* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

The present invention includes methods for treating or preventing an infection with Nippostrongylus *brasiliensis* in a subject comprising administering an effective amount of an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) to a subject, such as a human, in need thereof.

A "subject" is a mammal such as, for example, a human, dog, cat, horse, cow, mouse, rat, monkey (e.g., cynomolgous monkey, e.g., *Macaca fascicularis* or *Macaca mulatta*) or rabbit.

In particular embodiments, the anti-LAG3 antibodies (e.g., humanized antibodies such as antagonist humanized antibodies) or antigen-binding fragments thereof of the present invention which are disclosed herein (e.g., 4A10, 19E8, 11C9 and/or 22D2; e.g., Ab1, Ab2, Ab3, Ab4, Ab5, Ab6, Ab7, Ab8 and/or Ab9) may be used alone, or in association with other, further therapeutic agents and/or therapeutic procedures, for treating or preventing any disease such as cancer, e.g., as discussed herein, in a subject in need of such treatment or prevention. Compositions or kits, e.g., pharmaceutical compositions comprising a pharmaceutically acceptable carrier, comprising such antibodies and fragments in association with further therapeutic agents are also part of the present invention.

In particular embodiments, the anti-LAG3 antibodies (e.g., humanized antibody such as antagonist humanized antibodies) or antigen-binding fragments thereof of the present invention (e.g., 4A10, 19E8, 11C9 and/or 22D2; e.g., Ab1, Ab2, Ab3, Ab4, Ab5, Ab6, Ab7, Ab8 and/or Ab9) may be used in association with an anti-cancer therapeutic agent or immunomodulatory drug such as an immunomodulatory receptor inhibitor, e.g., an antibody or antigen-binding fragment thereof that specifically binds to the receptor.

In an embodiment of the invention, an anti-LAG3 antibody (e.g., humanized antibodies such as antagonist humanized antibodies) or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) is in association with one or more of an inhibitors (e.g., a small organic molecule or an antibody or antigen-binding fragment thereof) such as: an MTOR (mammalian target of rapamycin) inhibitor, a cytotoxic agent, a platinum agent a BRAF inhibitor, a CDK4/6 inhibitor an EGFR inhibitor, a VEGF inhibitor, a microtubule stabilizer, a taxane, a CD20 inhibitor, a CD52 inhibitor, a CD30 inhibitor, a RANK (Receptor activator of nuclear factor kappa-B) inhibitor, a RANKL (Receptor activator of nuclear factor kappa-B ligand) inhibitor, an ERK inhibitor, a MAP Kinase inhibitor, an AKT inhibitor, a MEK inhibitor, a PI3K inhibitor, a HER1 inhibitor, a HER2 inhibitor, a HER3 inhibitor, a HER4 inhibitor, a Bcl2 inhibitor, a CD22 inhibitor, a CD79b inhibitor, an ErbB2 inhibitor, or a farnesyl protein transferase inhibitor.

In an embodiment of the invention, an anti-LAG3 antibody (e.g., humanized antibody such as antagonist humanized antibodies) or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) is in association with one or more of: anti-PD1 (e.g., pembrolizumab, nivolumab, CT-011), anti-PDL1, anti-CTLA4, anti-TIM3, anti-CS1, (e.g., elotuzumab), anti-KIR2DL1/2/3 (e.g., lirilumab), anti-CD27, anti-CD137 (e.g., urelumab), anti-GITR (e.g., TRX518), anti-PD-L1 (e.g., BMS-936559, MSB0010718C or MPDL3280A), anti-PD-L2, anti-ILT1, anti-ILT2, anti-ILT3, anti-ILT4, anti-ILT5, anti-ILT6, anti-ILT7, anti-ILT8, anti-CD40, anti-OX40, anti-CD137, anti-KIR2DL1, anti-KIR2DL2/3, anti-KIR2DL4, anti-KIR2DL5A, anti-KIR2DL5B, anti-KIR3DL1, anti-KIR3DL2, anti-KIR3DL3, anti-NKG2A, anti-NKG2C, anti-NKG2E, or any small organic molecule inhibitor of such targets; IL-10, anti-IL10, anti-TSLP (thymic stromal lymphopoietin) or PEGylated IL-10.

In an embodiment of the invention, the molecular weight of the polyethylene glycol (PEG) moiety, on a PEGylated IL-10 molecule, is about 12,000 daltons or about 20,000 daltons. In an embodiment of the invention, PEGylated IL-10 (e.g., PEGylated human IL-10) comprises one or more polyethylene glycol molecules covalently attached via a linker (e.g., $C_{2-12}$ alkyl such as —$CH_2CH_2CH_2$—) to a single amino acid residue of a single subunit of IL-10, wherein said amino acid residue is the alpha amino group of the N-terminal amino acid residue or the epsilon amino group of a lysine residue. In an embodiment of the invention PEGylated IL-10 is: $(PEG)_b$-L-NH-IL-10; wherein b is 1-9 and L is a $C_{2-12}$ alkyl linker moiety covalently attached to a nitrogen (N) of the single amino acid residue of the IL-10. In an embodiment of the invention, the IL-10 of PEGylated IL-10 has the formula: $[X—O(CH_2CH_2O)_n]_b$-L-NH-IL-10, wherein X is H or $C_{1-4}$ alkyl; n is 20 to 2300; b is 1 to 9; and L is a $C_{1-11}$ alkyl linker moiety which is covalently attached to the nitrogen (N) of the alpha amino group at the amino terminus of one IL-10 subunit; provided that when b is greater than 1, the total of n does not exceed 2300. See U.S. Pat. No. 7,052,686.

In an embodiment of the invention, the anti-IL-10 antibody or antigen-binding fragment thereof (e.g., humanized antibody) comprises the CDRs set forth below:

```
                              (SEQ ID NO: 465)
CDR-L1: KTSQNIFENLA (SEQ ID NO: 466)
CDR-L2: NASPLQA (SEQ ID NO: 467)
CDR-L3: HQYYSGYT (SEQ ID NO: 468)
CDR-H1: GFTFSDYHMA (SEQ ID NO: 469)
CDR-H2: SITLDATYTYYRDSVRG (SEQ ID NO: 470)
CDR-H3: HRGFSVWLDY (See U.S. Pat. No. 7,662,379)
```

In an embodiment of the invention, the anti-TSLP antibody or antigen-binding fragment thereof (e.g., humanized antibody) comprises the CDRs set forth below:

```
                              (SEQ ID NO: 428)
CDR-H1: GYIFTDYAMH;

(SEQ ID NO: 429)
CDR-H2: TFIPLLDTSDYNQNFK;

(SEQ ID NO: 430)
CDR-H3: MGVTHSYVMDA;

(SEQ ID NO: 431)
CDR-L1: RASQPISISVH;

(SEQ ID NO: 432)
CDR-L2: FASQSIS;

(SEQ ID NO: 433)
CDR-L3: QQTFSLPYT ;

(see WO2008/76321)
```

In an embodiment of the invention, the anti-CD27 antibody or antigen-binding fragment thereof (e.g., humanized antibody) comprises the CDRs set forth below:

```
                              (SEQ ID NO: 420)
CDR-H1: GFIIKATYMH;

(SEQ ID NO: 421)
CDR-H2: RIDPANGETKYDPKFQV;

(SEQ ID NO: 422)
CDR-H3: YAWYFDV;

(SEQ ID NO: 423)
CDR-L1: RASENIYSFLA;

(SEQ ID NO: 424)
CDR-L2: HAKTLAE;

(SEQ ID NO: 425)
CDR-L3: QHYYGSPLT;

(See WO2012/04367).
```

Thus, the present invention includes compositions comprising an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) in association with pembrolizumab; as well as methods for treating or preventing cancer in a subject comprising administering an effective amount of the anti-LAG3 antibody or antigen-binding fragment thereof in association with pembrolizumab (e.g., pembrolizumab dosed at 200 mg once every three weeks) to the subject. Optionally, the subject is also administered in association with a another further therapeutic agent.

In an embodiment of the invention, an anti-LAG3 antibody (e.g., humanized antibody such as antagonist humanized antibodies) or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a pembrolizumab antibody which comprises an immunoglobulin heavy chain (or CDR-H1, CDR-H2 and CDR-H3 thereof) comprising the amino acid sequence:

```
                              (SEQ ID NO: 41)
QVQLVQSGVEVKKPGASVKVSCKASGYTFTNYYMYWVRQAPGQGLEWMGG

INPSNGGTNFNEKFKNRVTLTTDSSTTTAYMELKSLQFDDTAVYYCARRD

YRFDMGFDYWGQGTTVTVSSASTKGPSVFPLAPCSRSTSESTAALGCLVK
```

-continued

```
DYFPEPVTVSWNSGALTSGVHTFPAVLQSSGLYSLSSVVTVPSSSLGTKT

YTCNVDHKPSNTKVDKRVESKYGPPCPPCPAPEFLGGPSVFLFPPKPKDT

LMISRTPEVTCVVVDVSQEDPEVQFNWYVDGVEVHNAKTKPREEQFNSTY

RVVSVLTVLHQDWLNGKEYKCKVSNKGLPSSIEKTISKAKGQPREPQVYT

LPPSQEEMTKNQVSLTCLVKGFYPSDIAVEWESNGQPENNYKTTPPVLDS

DGSFFLYSRLTVDKSRWQEGNVFSCSVMHEALHNHYTQKSLSLSLGK;
``` and an immunoglobulin light chain (or CDR-L1, CDR-L2 and CDR-L3 thereof) comprising the amino acid sequence:

```
                                         (SEQ ID NO: 42)
EIVLTQSPATLSLSPGERATLSCRASKGVSTSGYSYLHWYQQKPGQAPRL

LIYLASYLESGVPARFSGSGSGTDFTLTISSLEPEDFAVYYCQHSRDLPL

TFGGGTKVEIKRTVAAPSVFIFPPSDEQLKSGTASVVCLLNNFYPREAKV

QWKVDNALQSGNSQESVTEQDSKDSTYSLSSTLTLSKADYEKHKVYACEV

THQGLSSPVTKSFNRGEC.
```

In an embodiment of the invention, an anti-LAG3 antibody (e.g., humanized antibody such as antagonist humanized antibodies) or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) is in association with an antibody comprising an immunoglobulin heavy chain (or CDR-H1, CDR-H2 and CDR-H3 thereof) comprising the amino acid sequence:

```
                                         (SEQ ID NO: 43)
QVQLVESGGGVVQPGRSLRLDCKASGITFSNSGMHWVRQAPGKGLEWVAV

IWYDGSKRYYADSVKGRFTISRDNSKNTLFLQMNSLRAEDTAVYYCATND

DYWGQGTLVTVSSASTKGPSVFPLAPCSRSTSESTAALGCLVKDYFPEPV

TVSWNSGALTSGVHTFPAVLQSSGLYSLSSVVTVPSSSLGTKTYTCNVDH

KPSNTKVDKRVESKYGPPCPPCPAPEFLGGPSVFLFPPKPKDTLMISRTP

EVTCVVVDVSQEDPEVQFNWYVDGVEVHNAKTKPREEQFNSTYRVVSVLT

VLHQDWLNGKEYKCKVSNKGLPSSIEKTISKAKGQPREPQVYTLPPSQEE

MTKNQVSLTCLVKGFYPSDIAVEWESNGQPENNYKTTPPVLDSDGSFFLY

SRLTVDKSRWQEGNVFSCSVMHEALHNHYTQKSLSLSLGK;
``` and an immunoglobulin light chain (or CDR-L1, CDR-L2 and CDR-L3 thereof) comprising the amino acid sequence:

```
                                         (SEQ ID NO: 44)
EIVLTQSPATLSLSPGERATLSCRASQSVSSYLAWYQQKPGQAPRLLIYD

ASNRATGIPARFSGSGSGTDFTLTISSLEPEDFAVYYCQQSSNWPRTFGQ

GTKVEIKRTVAAPSVFIFPPSDEQLKSGTASVVCLLNNFYPREAKVQWKV

DNALQSGNSQESVTEQDSKDSTYSLSSTLTLSKADYEKHKVYACEVTHQG

LSSPVTKSFNRGEC.
```

In an embodiment of the invention, an anti-LAG3 antibody (e.g., humanized antibody such as antagonist humanized antibodies) or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) is in association with any one or more of: 13-cis-retinoic acid, 3-[5-(methylsulfonylpiperadinemethyl)-indolyl]-quinolone, 4-hydroxytamoxifen, 5-deooxyuridine, 5'-deoxy-5-fluorouridine, 5-fluorouracil, 6-mecaptopurine, 7-hydroxystaurosporine, A-443654, abirateroneacetate, abraxane, ABT-578, acolbifene, ADS-100380, aflibercept, ALT-110, altretamine, amifostine, aminoglutethimide, amrubicin, amsacrine, anagrelide, anastrozole, angiostatin, AP-23573, ARQ-197, arzoxifene, AS-252424, AS-605240, asparaginase, ATI3387, AT-9263, atrasentan, axitinib, AZD1152, *Bacillus* Calmette-Guerin (BCG) vaccine, batabulin, BC-210, besodutox, bevacizumab, BGJ398, bicalutamide, Bio111, BIO140, BKM120, bleomycin, BMS-214662, BMS-247550, BMS-275291, BMS-310705, bortezimib, buserelin, busulfan, calcitriol, camptothecin, canertinib, capecitabine, carboplatin, carmustine, CC8490, CEA (recombinant vaccinia-carcinoembryonic antigen vaccine), cediranib, CG-1521, CG-781, chlamydocin, chlorambucil, chlorotoxin, cilengitide, cimitidine, cisplatin, cladribine, clodronate, cobimetnib, COL-3, CP-724714, cyclophosphamide, cyproterone, cyproteroneacetate, cytarabine, cytosinearabinoside, dabrafenib, dacarbazine, dacinostat, dactinomycin, dalotuzumab, danusertib, dasatanib, daunorubicin, decatanib, deguelin, denileukin, deoxycoformycin, depsipeptide, diarylpropionitrile, diethylstilbestrol, diftitox, DNE03, docetaxel, dovitinib, doxorubicin, droloxifene, edotecarin, yttrium-90 labeled-edotreotide, edotreotide, EKB-569, EMD121974, encorafenib, endostatin, enzalutamide, enzastaurin, epirubicin, epithilone B, ERA-923, erbitux, erlotinib, estradiol, estramustine, etoposide, everolimus, exemestane, ficlatuzumab, finasteride, flavopiridol, floxuridine, fludarabine, fludrocortisone, fluoxymesterone, flutamide, FOLFOX regimen, fulvestrant, galeterone, ganetespib, gefitinib, gemcitabine, gimatecan, glucopyranosyl lipid A, go serelin, goserelin acetate, gossypol, GSK461364, GSK690693, HMR-3339, hydroxyprogesteronecaproate, hydroxyurea, IC87114, idarubicin, idoxyfene, ifosfamide, IM862, imatinib, IMC-1C11, imiquimod, INC280, INCB24360, INO1001, interferon, interleukin-2, interleukin-12, ipilimumab, irinotecan, JNJ-16241199, ketoconazole, KRX-0402, lapatinib, lasofoxifene, LEE011, letrozole, leucovorin, leuprolide, leuprolide acetate, levamisole, liposome entrapped paclitaxel, lomustine, lonafarnib, lucanthone, LY292223, LY292696, LY293646, LY293684, LY294002, LY317615, LY3009120, marimastat, mechlorethamine, medroxyprogesteroneacetate, megestrolacetate, MEK162, melphalan, mercaptopurine, mesna, methotrexate, mithramycin, mitomycin, mitotane, mitoxantrone, a suspension of heat killed *Mycobacterium obuense*, tozasertib, MLN8054, natitoclax, neovastat, Neratinib, neuradiab, nilotinib, nilutimide, nolatrexed, NVP-BEZ235, oblimersen, octreotide, ofatumumab, oregovomab, ornatuzumab, orteronel, oxaliplatin, paclitaxel, palbociclib, pamidronate, panitumumab, pazopanib, PD0325901, PD184352, PEG-interferon, pemetrexed, pentostatin, perifosine, phenylalaninemustard, PI-103, pictilisib, PIK-75, pipendoxifene, PKI-166, plicamycin, poly-ICLC, porfimer, prednisone, procarbazine, progestins, PSK protein bound polysaccharide (derived from Basidiomycete *coriolus versicolor*), PLX8394, PX-866, R-763, raloxifene, raltitrexed, razoxin, ridaforolimus, rituximab, romidepsin, RTA744, rubitecan, scriptaid, Sdx102, seliciclib, selumetinib, semaxanib, SF1126, sirolimus, SN36093, sorafenib, spironolactone, squalamine, SR13668, streptozocin, SU6668, suberoylanalide hydroxamic acid, sunitinib, synthetic estrogen, talampanel, talimogene laherparepvec, tamoxifen, temozolomide, temsirolimus, teniposide, tesmilifene, testosterone, tetrandrine, TGX-221, thalidomide, 6-thioguanine, thiotepa, ticilimumab, tipifarnib, tivozanib, TKI-258, TLK286, TNFα (tumor necrosis factor alpha), topotecan, toremifene citrate, trabectedin, trametinib, trastuzumab, tretinoin, trichostatin A, triciribinephosphate monohydrate, triptorelin pamoate, TSE-424, uracil mustard, valproic acid, valrubicin, vandetanib, vatalanib, VEGF trap, vemurafenib, vinblastine, vincristine, vindesine, vinorelbine, vitaxin, vitespan, vorinostat, VX-745, wortmannin, Xr311, Z-100 hot water extract of *Bacillus* tuberculosis, zanolimumab, ZK186619, ZK-304709, ZM336372 or ZSTK474.

In an embodiment of the invention, an anti-LAG3 antibody (e.g., humanized antibody such as antagonist humanized antibodies) or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) is in association with one or more antiemetics including, but not limited to: casopitant (GlaxoSmithKline), Netupitant (MGI-Helsinn) and other NK-1 receptor antagonists, palonosetron (sold as Aloxi by MGI Pharma), aprepitant (sold as Emend by Merck and Co.; Rahway, N.J.), diphenhydramine (sold as Benadryl® by Pfizer; New York, N.Y.), hydroxyzine (sold as Atarax® by Pfizer; New York, N.Y.), metoclopramide (sold as Reglan® by AH Robins Co; Richmond, Va.), lorazepam (sold as Ativan® by Wyeth; Madison, N.J.), alprazolam (sold as Xanax® by Pfizer; New York, N.Y.), haloperidol (sold as Haldol® by Ortho-McNeil; Raritan, N.J.), droperidol (Inapsine®), dronabinol (sold as Marinol® by Solvay Pharmaceuticals, Inc.; Marietta, Ga.), dexamethasone (sold as Decadron® by Merck and Co.; Rahway, N.J.), methylprednisolone (sold as Medrol® by Pfizer; New York, N.Y.), prochlorperazine (sold as Compazine® by Glaxosmithkline; Research Triangle Park, N.C.), granisetron (sold as Kytril® by Hoffmann-La Roche Inc.; Nutley, N.J.), ondansetron (sold as Zofran® by Glaxosmithkline; Research Triangle Park, N.C.), dolasetron (sold as Anzemet® by Sanofi-Aventis; New York, N.Y.), tropisetron (sold as Navoban® by Novartis; East Hanover, N.J.).

Other side effects of cancer treatment include red and white blood cell deficiency. Accordingly, in an embodiment of the invention, an anti-LAG3 antibody (e.g., humanized antibody such as antagonist humanized antibodies) or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) is in association with an agent which treats or prevents such a deficiency, such as, e.g., filgrastim, PEG-filgrastim, erythropoietin, epoetin alfa or darbepoetin alfa.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a vaccine. In an embodiment of the invention, the vaccine is an anti-cancer vaccine, a peptide vaccine or a DNA vaccine. For example, in an embodiment of the invention, the vaccine is a tumor cell (e.g., an irradiated tumor cell) or a dendritic cell (e.g., a dendritic cell pulsed with a tumor peptide).

In an embodiment of the invention, an anti-LAG3 antibody (e.g., humanized antibody such as antagonist humanized antibodies) or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) is administered in association with a therapeutic procedure. A therapeutic procedure is one or more steps carried out by a physician or clinician in treating a subject which is intended to alleviate one or more symptoms (e.g., of cancer and/or infectious disease) in the treated subject, whether by inducing the regression or elimination of such symptoms or by inhibiting the progression of such symptom(s), e.g., cancer symptoms such as tumor growth or metastasis, by any clinically measurable degree.

In an embodiment of the invention, a therapeutic procedure is anti-cancer radiation therapy. For example, in an embodiment of the invention, the radiation therapy is external beam therapy (EBT): a method for delivering a beam of high-energy X-rays to the location of the tumor. The beam is generated outside the patient (e.g., by a linear accelerator) and is targeted at the tumor site. These X-rays can destroy the cancer cells and careful treatment planning allows the surrounding normal tissues to be spared. No radioactive sources are placed inside the patient's body. In an embodiment of the invention, the radiation therapy is proton beam therapy: a type of conformal therapy that bombards the diseased tissue with protons instead of X-rays. In an embodiment of the invention, the radiation therapy is conformal external beam radiation therapy: a procedure that uses advanced technology to tailor the radiation therapy to an individual's body structures.

In an embodiment of the invention, the radiation therapy is brachytherapy: the temporary placement of radioactive materials within the body, usually employed to give an extra dose—or boost—of radiation to an area.

In an embodiment of the invention, a surgical procedure administered in association with an anti-LAG3 antibody (e.g., humanized antibody such as antagonist humanized antibodies) or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) is surgical tumorectomy.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with an MTOR (mammalian target of rapamycin) inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a cytotoxic agent.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a platinum agent.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with an EGFR inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a VEGF inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a microtubule stabilizer.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a taxane a CD20 inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a CD52 inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a CD30 inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a RANK (Receptor activator of nuclear factor kappa-B) inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a RANKL (Receptor activator of nuclear factor kappa-B ligand) inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a BRAF inhibitor, e.g., for treatment of melanoma.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with an a CDK4/6 inhibitor, e.g., for treatment of melanoma.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with an ERK inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a MAP Kinase inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with an AKT inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a MEK inhibitor, e.g., for treatment of melanoma.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a PI3K inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a HER1 inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a HER2 inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a HER3 inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a HER4 inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a Bcl2 inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a CD22 inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a CD79b inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with an ErbB2 inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a farnesyl protein transferase inhibitor.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-PD1.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with nivolumab.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with CT-011.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-PDL1.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-CTLA4.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-TIM3.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-CS1.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with elotuzumab.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-KIR2DL1/2/3.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with lirilumab.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with an anti-CD137 antibody or antigen-binding fragment thereof, e.g., an agonist anti-CD137 antibody or fragment.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with urelumab.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-GITR.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with TRX518.

In an embodiment of the invention, an anti-LAG3 antibody or antigen-binding fragment (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-PD-L1.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with BMS-936559.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with MSB0010718C.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with MPDL3280A.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-PD-L2.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-ILT1.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-ILT2.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-ILT3.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-ILT4.

In an embodiment of the invention, an anti-LAG3 antibody or antigen-binding fragment thereof (e.g., humanized antibody such as antagonist humanized antibodies) of the present and/or Ab9) is in association with anti-ILT5.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-ILT6.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-ILT7.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-ILT8.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-CD40.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-OX40.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-CD137.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-KIR2DL1.

In an embodiment of the invention, an anti-LAG3 antibody or antigen-binding fragment thereof (e.g., humanized antibody such as antagonist humanized antibodies) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-KIR2DL2/3.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-KIR2DL4.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-KIR2DL5A.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-KIR2DL5B.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-KIR3DL1.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-KIR3DL2.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-KIR3DL3.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-NKG2A.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-NKG2C.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-NKG2E.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with IL-10.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-IL10.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anti-TSLP (thymic stromal lymphopoietin).

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with PEGylated IL-10. In an embodiment of the invention, PEGylated-IL-10 is administered to the subject at a dose of up to 20 micrograms/kg (e.g., 1, 2, 3, 4, 5, 6, 7, 8, 9, 10, 11, 12, 13, 14, 15, 16, 17, 18, 19 or 20 micrograms/kg). For example, up to 20 micrograms/kg daily, e.g., for up to four (e.g., 1, 2, 3 or 4) 28 day cycles—e.g., 20 micrograms/kg/day for four 28 day cycles.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with 13-cis-retinoic acid.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with 3-[5-(methylsulfonylpiperadinemethyl)-indolyl]-quinolone.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with 4-hydroxytamoxifen.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with 5-deooxyuridine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with 5'-deoxy-5-fluorouridine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with 5-fluorouracil.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with 6-mecaptopurine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with 7-hydroxystaurosporine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with A-443654.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with abirateroneacetate.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with abraxane.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ABT-578.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with acolbifene.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ADS-100380.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ALT-110.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with altretamine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with amifostine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with aminoglutethimide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with amrubicin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with Amsacrine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anagrelide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with anastrozole.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with angiostatin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with AP-23573.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ARQ-197.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with arzoxifene.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with AS-252424.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with AS-605240.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with asparaginase.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with AT-9263.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with atrasentan.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with axitinib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with AZD1152.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with *Bacillus* Calmette-Guerin (BCG) vaccine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with batabulin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with BC-210.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with besodutox.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with bevacizumab.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with bicalutamide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with Bio111.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with BIO140.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with bleomycin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with BMS-214662.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with BMS-247550.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with BMS-275291.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with BMS-310705.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with bortezimib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with buserelin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with busulfan.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with calcitriol.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with camptothecin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with canertinib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with capecitabine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with carboplatin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with carmustine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with CC8490.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with CEA (recombinant vaccinia-carcinoembryonic antigen vaccine).

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with cediranib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with CG-1521.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with CG-781.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with chlamydocin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with chlorambucil.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with chlorotoxin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with cilengitide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with cimitidine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with cisplatin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with cladribine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with clodronate.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with COL-3.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with CP-724714.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with cyclophosphamide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with cyproterone.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with cyproteroneacetate.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with cytarabine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with cytosinearabinoside.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with dacarbazine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with dacinostat.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with dactinomycin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with dalotuzumab.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with danusertib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with dasatanib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with daunorubicin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with decatanib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with deguelin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with denileukin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with deoxycoformycin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with depsipeptide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with diarylpropionitrile.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with diethylstilbestrol.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with diftitox.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with docetaxel.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with dovitinib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with doxorubicin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with droloxifene.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with edotecarin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with yttrium-90 labeled-edotreotide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with edotreotide.

In an embodiment of the invention, an anti-LAG3 antibody or antigen-binding fragment thereof (e.g., humanized antibody such as an antagonist humanized antibody) of the present and/or Ab9) is in association with EKB-569.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with EMD121974.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with endostatin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with enzalutamide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with enzastaurin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with epirubicin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with epithilone B.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ERA-923.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with Cetuximab.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with erlotinib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with estradiol.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with estramustine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with etoposide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with everolimus.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with exemestane.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ficlatuzumab.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with finasteride.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with flavopiridol.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with floxuridine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with fludarabine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with fludrocortisone.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with fluoxymesterone.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with flutamide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with FOLFOX regimen.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with fulvestrant.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with galeterone.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with gefitinib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with gemcitabine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with gimatecan.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with glycopyranosyl lipid A.

In an embodiment of the invention, an anti-LAG3 antibody or antigen-binding fragment thereof (e.g., humanized antibody such as an antagonist humanized antibody) of the present and/or Ab9) is in association with goserelin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with goserelin acetate.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with gossypol.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with GSK461364.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with GSK690693.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with HMR-3339.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with hydroxyprogesteronecaproate.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with hydroxyurea.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with IC87114.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with idarubicin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with idoxyfene.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ifosfamide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with IM862.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with imatinib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with imiquimod.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with IMC-1C11.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with INCB24360.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with INO1001.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with interferon.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with interleukin-2 (IL-2).

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with interleukin-12 (IL-12).

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ipilimumab.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with irinotecan.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with JNJ-16241199.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ketoconazole.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with KRX-0402.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with lapatinib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with lasofoxifene.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with letrozole.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with leucovorin.

In an embodiment of the invention, an anti-LAG3 antibody or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) is in association with leuprolide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with leuprolide acetate.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with levamisole.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with liposome entrapped paclitaxel.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with lomustine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with lonafarnib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with lucanthone.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with LY292223.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with LY292696.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with LY293646.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with LY293684.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with LY294002.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with LY317615.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with marimastat.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with mechlorethamine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with medroxyprogesteroneacetate.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with megestrolacetate.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with melphalan.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with mercaptopurine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with mesna.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with methotrexate.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with mithramycin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with mitomycin.

In an embodiment of the invention, an anti-LAG3 antibody or antigen-binding fragment thereof (e.g., humanized antibody such as an antagonist humanized antibody) of the present and/or Ab9) is in association with mitotane.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with mitoxantrone.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with tozasertib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with a suspension of heat killed *Mycobacterium obuense*.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with MLN8054.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with neovastat.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with Neratinib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with neuradiab.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with nilotinib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with nilutimide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with nolatrexe.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with NVP-BEZ235.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with oblimersen.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with octreotide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ofatumumab.

In an embodiment of the invention, an anti-LAG3 antibody or antigen-binding fragment thereof (e.g., humanized antibody such as an antagonist humanized antibody) of the present and/or Ab9) is in association with oregovomab.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with orteronel.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with oxaliplatin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with paclitaxel.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with palbociclib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with pamidronate.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with panitumumab.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with pazopanib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with PD0325901.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with PD184352.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with PEG-interferon.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with pemetrexed.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with pentostatin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with perifosine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with phenylalanine mustard.

In an embodiment of the invention, an anti-LAG3 antibody or antigen-binding fragment thereof (e.g., humanized antibody such as an antagonist humanized antibody) of the present and/or Ab9) is in association with PI-103.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with pictilisib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with PIK-75.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with pipendoxifene.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with PKI-166.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with plicamycin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with poly-ICLC.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with porfimer.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with prednisone.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with procarbazine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with progestins.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with PSK protein bound polysaccharide (derived from Basidiomycete *coriolus versicolor*).

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with PX-866.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with R-763.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with raloxifene.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with raltitrexed.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with razoxin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ridaforolimus.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with rituximab.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with romidepsin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with RTA744.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with rubitecan.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with scriptaid.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with Sdx102.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with seliciclib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with selumetinib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with semaxanib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with SF1126.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with sirolimus.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with SN36093.

In an embodiment of the invention, an anti-LAG3 antibody or antigen-binding fragment thereof (e.g., humanized antibody such as an antagonist humanized antibody) of the present and/or Ab9) is in association with sorafenib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with spironolactone.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with squalamine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with SR13668.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with streptozocin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with SU6668.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with suberoylanalide hydroxamic acid.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with sunitinib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with synthetic estrogen.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with talampanel.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with talimogene laherparepvec.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with tamoxifen.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with temozolomide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with temsirolimus.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with teniposide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with tesmilifene.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with testosterone.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with tetrandrine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with TGX-221.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with thalidomide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with 6-thioguanine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with thiotepa.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ticilimumab.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with tipifarnib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with tivozanib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with TKI-258.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with TLK286.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with topotecan.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with toremifene citrate.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with trabectedin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with trastuzumab.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with tretinoin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with trichostatin A.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with triciribinephosphate monohydrate.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with triptorelin pamoate.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with TSE-424.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with tumor necrosis factor alpha (TNFα).

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with uracil mustard.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with valproic acid.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with valrubicin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with vandetanib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with vatalanib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with VEGF trap.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with vinblastine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with vincristine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with vindesine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with vinorelbine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with vitaxin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with vitespan.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with vorinostat.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with VX-745.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with wortmannin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with Xr311.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with zanolimumab.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with Z-100 hot water extract of *Bacillus* tuberculosis.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ZK186619.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ZK-304709.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ZM336372.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ZSTK474.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with casopitant.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with netupitant.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with an NK-1 receptor antagonist.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with palonosetron.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with aprepitant.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with diphenhydramine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with hydroxyzine.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with metoclopramide.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with lorazepam.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with alprazolam.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with haloperidol.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with droperidol.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with dronabinol.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with dexamethasone.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with methylprednisolone.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with prochlorperazine.

In an embodiment of the invention, an anti-LAG3 antibody or antigen-binding fragment thereof (e.g., humanized antibody such as an antagonist humanized antibody) of the present and/or Ab9) is in association with granisetron.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ondansetron.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with dolasetron.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with tropisetron.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with filgrastim.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with PEG-filgrastim.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with erythropoietin.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with epoetin alfa.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with darbepoetin alfa.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with dabrafenib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with trametinib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with vemurafenib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with cobimetnib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with LY3009120.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with DNE03.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ATI13387.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ganetespib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with encorafenib.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with MEK162.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with BKM120.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with LEE011.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with BGJ398.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with INC280.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with PLX8394.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with ornatuzumab.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with natitoclax.

In an embodiment of the invention, an anti-LAG3 antibody or antigen-binding fragment thereof (e.g., humanized antibody such as an antagonist humanized antibody) of the present invention (e.g., 4A10, 19E8, 11C9 and/or 22D2; e.g., Ab1, Ab2, Ab3, Ab4, Ab5, Ab6, Ab7, Ab8 and/or Ab9) is in association with aflibercept.

The term "in association with" indicates that the components, an anti-LAG3 antibody (e.g., humanized antibody such as antagonist humanized antibodies) or antigen-binding fragment thereof of the present invention (e.g., 4A10, 19E8, 11C9 and/or 22D2; e.g., Ab1, Ab2, Ab3, Ab4, Ab5, Ab6, Ab7, Ab8 and/or Ab9) along with another agent such as pembrolizumab or nivolumab, can be formulated into a single composition, e.g., for simultaneous delivery, or formulated separately into two or more compositions (e.g., a kit). Each component can be administered to a subject at a different time than when the other component is administered; for example, each administration may be given non-simultaneously (e.g., separately or sequentially) at intervals over a given period of time. Moreover, the separate components may be administered to a subject by the same or by a different route (e.g., wherein an anti-LAG3 antibody (e.g., humanized antibody such as antagonist humanized antibodies) or antigen-binding fragment thereof (e.g., 4A10, 19E8, 11C9 and/or 22D2; e.g., Ab1, Ab2, Ab3, Ab4, Ab5, Ab6, Ab7, Ab8 and/or Ab9 is administered parenterally and paclitaxel is administered orally).

Assays and Experimental and Diagnostic Uses

The present invention includes any method for forming a complex between an anti-LAG3 antibody or antigen-binding fragment thereof of the present invention and LAG3 (e.g., human or cynomolgous monkey LAG3) comprising contacting the LAG3 polypeptide with the anti-LAG3 antibody or fragment under conditions suitable for binding and complex formation.

The anti-LAG3 antibodies (e.g., humanized antibodies such as antagonist humanized antibodies) and antigen-binding fragments thereof disclosed herein (e.g., 4A10, 19E8, 11C9 and/or 22D2; e.g., Ab1, Ab2, Ab3, Ab4, Ab5, Ab6, Ab7, Ab8 and/or Ab9) may be used as affinity purification agents. In this process, the anti-LAG3 antibodies and antigen-binding fragments thereof are immobilized on a solid phase such a sephadex, glass or agarose resin or filter paper, using methods well known in the art. The immobilized antibody or fragment is contacted with a sample containing the LAG3 protein (or a fragment thereof) to be purified, and, thereafter, the support is washed with a suitable solvent that will remove substantially all of the material in the sample except the LAG3 protein which is bound to the immobilized antibody or fragment. Finally, the support is washed with a solvent which elutes the bound LAG3 (e.g., protein A). Such immobilized antibodies and fragments form part of the present invention.

The present invention provides methods for using the anti-LAG3 antibodies and antigen-binding fragments thereof of the present invention to determine the extent of T-cell activation that a particular subject is having or could have in the present of the antibody or fragment. For example, embodiments of the invention include methods including (i) contacting T-cells (e.g., CD4+ T-cells) from a subject with superantigen (e.g., any one or more of a staphylococcal superantigen such as SEA, SEB (*Staphylococcus* enterotoxin B), SEC2, SEC3, SED, SEH and/or TSST; and/or any one or more of a streptococcal superantigen such as SPE-A, SPE-C, SPE-H and/or SMEZ-2), e.g., at a concentration of 500 pg/ml or more, such as about 10 ng/ml or 100 ng/ml, in the presence of the anti-LAG3 antibody or fragment (optionally, the T-cells are pre-incubated with the superantigen (e.g., SEB) and antibody or fragment for about 48 or 72 hours) and (ii) determining the level of production of cytokine (e.g., TNF-alpha, GM-CSF, IFN-gamma and/or IL-2) production of said T-cells; wherein the level of production of said cytokine(s) indicates the level of T-cell activation in the present of the antibody or fragment. Subjects possessing T-cells which exhibit cytokine production (e.g., high levels of cytokine production such as an anti-LAG3-dependent increase thereof) in the presence of superantigen and antibody are considered superior candidates for receipt of the antibody or fragment as a therapy, e.g., for treating cancer or infection. In an embodiment of the invention, such superior candidates are selected for receipt of the antibody or fragment. In an embodiment of the invention, such superior candidates are administered an effective amount of the antibody or fragment. In an embodiment of the invention, the method includes the step of isolating the T-cells from the blood of the subject. In an embodiment of the invention, the T-cells are contacted with anti-LAG3 antibody or antigen-binding fragment thereof of the present invention and pembrolizumab.

Further provided are antigens for generating secondary antibodies which are useful, for example, for performing Western blots and other immunoassays discussed herein. In particular, polypeptides are disclosed which comprise the variable regions and/or CDR sequences of an anti-LAG3 antibody or fragment disclosed herein (e.g., 4A10, 19E8, 11C9 and/or 22D2; e.g., Ab1, Ab2, Ab3, Ab4, Ab5, Ab6, Ab7, Ab8 and/or Ab9) and which may be used to generate anti-idiotypic antibodies for use in specifically detecting the presence of the antibody, e.g., in a therapeutic context.

The present invention includes cell-based ELISA methods using the anti-LAG3 antibodies and antigen-binding fragments thereof of the present invention. In an embodiment of the invention, the method includes the steps: (i) contacting cells (e.g., cells or tissue taken from a tumor, e.g., which include lymphocytes suspected of expressing LAG3) immobilized to a solid surface (e.g., a microplate) to be tested for the presence of LAG3 with an anti-LAG3 antibody or antigen-binding fragment thereof of the present invention, (ii) optionally washing the mixture to remove unbound anti-LAG3 antibody or fragment, (iii) contacting the anti-LAG3 antibody or fragment with a labeled secondary antibody or antigen-binding fragment thereof that binds to the anti-LAG3 antibody or fragment, (iv) optionally washing the complex to remove unbound antibodies or fragments and (v) detecting the presence of the label on the secondary antibody or fragment; wherein detection of the label indicates that the cells contain LAG3. For example, the present invention includes such cell-based ELISA methods for identifying LAG3+ cells in a tumor sample.

The present invention includes ELISA assays (enzyme-linked immunosorbent assay) incorporating the use of an anti-LAG3 antibody (e.g., humanized antibodies such as antagonist humanized antibodies) or antigen-binding fragment thereof disclosed herein (e.g., 4A10, 19E8, 11C9 and/or 22D2; e.g., Ab1, Ab2, Ab3, Ab4, Ab5, Ab6, Ab7, Ab8 and/or Ab9).

For example, such a method comprises the following steps:
(a) coat a substrate (e.g., surface of a microtiter plate well, e.g., a plastic plate) with anti-LAG3 antibody (e.g., humanized antibodies such as antagonist humanized antibodies) or antigen-binding fragment thereof (e.g., 4A10, 19E8, 11C9 and/or 22D2; e.g., Ab1, Ab2, Ab3, Ab4, Ab5, Ab6, Ab7, Ab8 and/or Ab9);
(b) apply a sample to be tested for the presence of LAG3 to the substrate (e.g., cells taken from a tumor, e.g., which include lymphocytes suspected of expressing LAG3);
(c) wash the plate, so that unbound material in the sample is removed;
(d) apply detectably labeled antibodies (e.g., enzyme-linked antibodies) which are also specific to the LAG3 antigen;
(e) wash the substrate, so that the unbound, labeled antibodies are removed;
(f) if the labeled antibodies are enzyme linked, apply a chemical which is converted by the enzyme into a fluorescent signal; and
(g) detect the presence of the labeled antibody.

Detection of the label associated with the substrate indicates the presence of the LAG3 protein. The ELISA methods can also be used identifying LAG3+ cells in a tumor sample.

In a further embodiment, the labeled antibody or antigen-binding fragment thereof is labeled with peroxidase which react with ABTS (e.g., 2,2'-azino-bis(3-ethylbenzthiazoline-6-sulphonic acid)) or 3,3',5,5'-Tetramethylbenzidine to produce a color change which is detectable. Alternatively, the labeled antibody or fragment is labeled with a detectable radioisotope (e.g., $^3$H) which can be detected by scintillation counter in the presence of a scintillant.

An anti-LAG3 antibody (e.g., humanized antibodies such as antagonist humanized antibodies) or antigen-binding fragment thereof of the invention (e.g., 4A10, 19E8, 11C9 and/or 22D2; e.g., Ab1, Ab2, Ab3, Ab4, Ab5, Ab6, Ab7, Ab8 and/or Ab9) may be used in a Western blot or immune-protein blot procedure. Such a procedure forms part of the present invention and includes e.g.:
(1) providing a membrane or other solid substrate comprising a sample to be tested for the presence of LAG3, e.g., optionally including the step of transferring proteins from a sample to be tested for the presence of LAG3 (e.g., from a PAGE or SDS-PAGE electrophoretic separation of the proteins in the sample) onto a membrane or other solid substrate using a method known in the art (e.g., semi-dry blotting or tank blotting); and contacting the membrane or other solid substrate to be tested for the presence of bound LAG3 or a fragment thereof with an anti-LAG3 antibody or antigen-binding fragment thereof of the invention.

Such a membrane may take the form, for example, of a nitrocellulose or vinyl-based (e.g., polyvinylidene fluoride (PVDF)) membrane to which the proteins to be tested for the presence of LAG3 in a non-denaturing PAGE (polyacrylamide gel electrophoresis) gel or SDS-PAGE (sodium dodecyl sulfate polyacrylamide gel electrophoresis) gel have been transferred (e.g., following electrophoretic separation in the gel). Before contacting the membrane with the anti-LAG3 antibody or fragment, the membrane is optionally blocked, e.g., with non-fat dry milk or the like so as to bind non-specific protein binding sites on the membrane.
(2) washing the membrane one or more times to remove unbound anti-LAG3 antibody or fragment and other unbound substances; and
(3) detecting the bound anti-LAG3 antibody or fragment.

Detection of the bound antibody or fragment indicates that the LAG3 protein is present on the membrane or substrate and in the sample. Detection of the bound antibody or fragment may be by binding the antibody or fragment with a secondary antibody (an anti-immunoglobulin antibody) which is detectably labeled and, then, detecting the presence of the secondary antibody label.

The anti-LAG3 antibodies (e.g., humanized antibodies such as antagonist humanized antibodies) and antigen-binding fragments thereof disclosed herein (e.g., 4A10, 19E8, 11C9 and/or 22D2; e.g., Ab1, Ab2, Ab3, Ab4, Ab5, Ab6, Ab7, Ab8 and/or Ab9) may also be used for immunohistochemistry. Such a method forms part of the present invention and comprises, e.g.,
(1) contacting tissue comprising TILs and tumor cells (e.g., melanoma tumor) to be tested for the presence of LAG3 protein with an anti-LAG3 antibody or antigen-binding fragment thereof of the invention; and (2) detecting the antibody or fragment on or in the TILs.

If the antibody or fragment itself is detectably labeled, it can be detected directly. Alternatively, the antibody or fragment may be bound by a detectably labeled secondary antibody wherein the label is then detected.

Certain anti-LAG3 antibodies and antigen-binding fragments thereof disclosed herein (e.g., 4A10, 19E8, 11C9 and/or 22D2; e.g., Ab1, Ab2, Ab3, Ab4, Ab5, Ab6, Ab7, Ab8 and/or Ab9) may also be used for in vivo tumor imaging. Such a method may include injection of a detectably labeled, e.g., radiolabeled, anti-LAG3 antibody or antigen-binding fragment thereof (as discussed herein) into the body of a patient to be tested for the presence of a tumor associated with LAG3 expression (e.g., which expresses LAG3, for example, on tumor infiltrating lymphocytes (TILs)) followed by imagine, e.g., nuclear imaging, of the body of the patient to detect the presence of the labeled antibody or fragment e.g., at loci comprising a high concentration of the antibody or fragment which are bound to or associated with the tumor. The detection of the loci indicates the presence of the LAG3$^+$ TILs in a tumor.

Imaging techniques include SPECT imaging (single photon emission computed tomography) or PET imaging (positron emission tomography). Labels include e.g., iodine-123 ($^{123}$I) and technetium-99m ($^{99m}$Tc), e.g., in conjunction with SPECT imaging or $^{11}$C, $^{13}$N, $^{15}$O or $^{18}$F, e.g., in conjunction with PET imaging or Indium-111 (See e.g., Gordon et al., (2005) International Rev. Neurobiol. 67:385-440).

The present invention provide a method for determining whether a tumor in a subject is sensitive to treatment with an anti-LAG3 antibody or antigen-binding fragment thereof of the present invention comprising determining whether the LAG3 is expressed in or on the tumor infiltrating lymphocytes (TILs) and, if said expression is identified, determining that the tumor is sensitive to said treatment. The TILs can be determined to express LAG3 using any of the methods set forth herein, e.g., ELISA or in vivo imaging. In an embodiment of the invention, the method comprises the step of obtaining a sample of said tumor tissue before making the determination of LAG3 expression is done. For example, in an embodiment of the invention, the sample is obtained surgically, e.g., by biopsy, for example, needle biopsy or partial tumorectomy. In an embodiment of the invention, LAG3 expression is determined by contacting the TILs with the antibody or fragment and detecting the presence of the antibody or fragment bound to the tumor tissue or fragment.

Pharmaceutical Compositions and Administration

To prepare pharmaceutical or sterile compositions of the anti-LAG3 antibodies (e.g., humanized antibodies such as antagonist humanized antibodies) and antigen-binding fragments thereof (e.g., 4A10, 19E8, 11C9 and/or 22D2; e.g., Ab1, Ab2, Ab3, Ab4, Ab5, Ab6, Ab7, Ab8 and/or Ab9), the antibody or antigen-binding fragment thereof is admixed with a pharmaceutically acceptable carrier or excipient. See, e.g., Remington's Pharmaceutical Sciences and U.S. Pharmacopeia: National Formulary, Mack Publishing Company, Easton, Pa. (1984). Such compositions are part of the present invention.

The scope of the present invention includes dessicated, e.g., freeze-dried, compositions comprising an anti-LAG3 antibody or antigen-binding fragment thereof or a pharmaceutical composition thereof that includes a pharmaceutically acceptable carrier but substantially lacks water.

Formulations of therapeutic and diagnostic agents may be prepared by mixing with acceptable carriers, excipients, or stabilizers in the form of, e.g., lyophilized powders, slurries, aqueous solutions or suspensions (see, e.g., Hardman, et al. (2001) Goodman and Gilman's The Pharmacological Basis of Therapeutics, McGraw-Hill, New York, N.Y.; Gennaro (2000) Remington: The Science and Practice of Pharmacy, Lippincott, Williams, and Wilkins, New York, N.Y.; Avis, et al. (eds.) (1993) Pharmaceutical Dosage Forms: Parenteral Medications, Marcel Dekker, NY; Lieberman, et al. (eds.) (1990) Pharmaceutical Dosage Forms: Tablets, Marcel Dekker, NY; Lieberman, et al. (eds.) (1990) Pharmaceutical Dosage Forms: Disperse Systems, Marcel Dekker, NY; Weiner and Kotkoskie (2000) Excipient Toxicity and Safety, Marcel Dekker, Inc., New York, N.Y.).

The present invention includes any pharmaceutical formulation comprising an anti-LAG3 antibody or antigen-binding fragment thereof of the present invention, and $PO_4^{2-}$, for example, sodium phosphate or potassium phosphate (e.g., about 10 mM), NaCl (e.g., about 7.5 mM) and sucrose (e.g., about 3%), e.g., having a pH of about 7.4 or about 7.3; or NaOAc (e.g., about 20 mM), and sucrose (about 7 or about 9%), e.g., having a pH of about 5.0.

Toxicity and therapeutic efficacy of the antibody or fragment compositions, administered alone or in combination with another therapeutic agent, can be determined by standard pharmaceutical procedures in cell cultures or experimental animals, e.g., for determining the $LD_{50}$ (the dose lethal to 50% of the population) and the $ED_{50}$ (the dose effective in 50% of the population). The dose ratio between toxic and therapeutic effects is the therapeutic index ($LD_{50}/ED_{50}$). In particular aspects, antibodies exhibiting high therapeutic indices are desirable. The data obtained from these cell culture assays and animal studies can be used in formulating a range of dosage for use in human. The dosage of such compounds lies preferably within a range of circulating concentrations that include the $ED_{50}$ with little or no toxicity. The dosage may vary within this range depending upon the dosage form employed and the route of administration.

In a further embodiment, a further therapeutic agent that is administered to a subject in association with an anti-LAG3 antibody (e.g., humanized antibody such as antagonist humanized antibodies) or antigen-binding fragment thereof disclosed herein (e.g., 4A10, 19E8, 11C9 and/or 22D2; e.g., Ab1, Ab2, Ab3, Ab4, Ab5, Ab6, Ab7, Ab8 and/or Ab9) is administered to the subject in accordance with the Physicians' Desk Reference 2003 (Thomson Healthcare; 57th edition (Nov. 1, 2002)).

The mode of administration can vary. Routes of administration include oral, rectal, transmucosal, intestinal, parenteral; intramuscular, subcutaneous, intradermal, intramedullary, intrathecal, direct intraventricular, intravenous, intraperitoneal, intranasal, intraocular, inhalation, insufflation, topical, cutaneous, transdermal, or intra-arterial.

The present invention provided methods for administering an anti-LAG3 antibody or antigen-binding fragment thereof comprising introducing the antibody or fragment into the body of a subject. For example, the method comprises piercing the body of the subject with a needle of a syringe and injecting the antibody or fragment into the body of the subject, e.g., into the vein, artery, tumor, muscular tissue or subcutis of the subject.

The present invention provides a vessel (e.g., a plastic or glass vial, e.g., with a cap or a chromatography column, hollow bore needle or a syringe cylinder) comprising any of the antibodies or antigen-binding fragments (e.g., 4A10, 19E8, 11C9 and/or 22D2; e.g., Ab1, Ab2, Ab3, Ab4, Ab5, Ab6, Ab7, Ab8 and/or Ab9), polypeptides or polynucleotides set forth herein or a pharmaceutical composition thereof comprising a pharmaceutically acceptable carrier.

The present invention also provides an injection device comprising any of the antibodies or antigen-binding fragments, polypeptides or polynucleotides set forth herein or a pharmaceutical composition thereof. An injection device is a device that introduces a substance into the body of a patient via a parenteral route, e.g., intramuscular, subcutaneous or intravenous. For example, an injection device may be a syringe (e.g., pre-filled with the pharmaceutical composition, such as an auto-injector) which, for example, includes a cylinder or barrel for holding fluid to be injected (e.g., comprising the antibody or fragment or a pharmaceutical composition thereof), a needle for piecing skin and/or blood vessels for injection of the fluid; and a plunger for pushing the fluid out of the cylinder and through the needle bore. In an embodiment of the invention, an injection device that comprises an antibody or antigen-binding fragment thereof of the present invention or a pharmaceutical composition thereof is an intravenous (IV) injection device. Such a device includes the antibody or fragment or a pharmaceutical composition thereof in a cannula or trocar/needle which may be attached to a tube which may be attached to a bag or reservoir for holding fluid (e.g., saline; or lactated ringer solution comprising NaCl, sodium lactate, KCl, $CaCl_2$ and optionally including glucose) introduced into the body of the patient through the cannula or trocar/needle. The antibody or fragment or a pharmaceutical composition thereof may, in an embodiment of the invention, be introduced into the device once the trocar and cannula are inserted into the vein of a subject and the trocar is removed from the inserted cannula. The IV device may, for example, be inserted into a peripheral vein (e.g., in the hand or arm); the superior vena cava or inferior vena cava, or within the right atrium of the heart (e.g., a central IV); or into a subclavian, internal jugular, or a femoral vein and, for example, advanced toward the heart until it reaches the superior vena cava or right atrium (e.g., a central venous line). In an embodiment of the invention, an injection device is an autoinjector; a jet injector or an external infusion pump. A jet injector uses a high-pressure narrow jet of liquid which penetrate the epidermis to introduce the antibody or fragment or a pharmaceutical composition thereof to a patient's body. External infusion pumps are medical devices that deliver the antibody or fragment or a pharmaceutical composition thereof into a patient's body in controlled amounts. External infusion pumps may be powered electrically or mechanically. Different pumps operate in different ways, for example, a syringe pump holds fluid in the reservoir of a syringe, and a moveable piston controls fluid delivery, an elastomeric pump holds fluid in a stretchable balloon reservoir, and pressure from the elastic walls of the balloon drives fluid delivery. In a peristaltic pump, a set of rollers pinches down on a length of flexible tubing, pushing fluid forward. In a multi-channel pump, fluids can be delivered from multiple reservoirs at multiple rates.

The pharmaceutical compositions disclosed herein may also be administered with a needleless hypodermic injection device; such as the devices disclosed in U.S. Pat. Nos. 6,620,135; 6,096,002; 5,399,163; 5,383,851; 5,312,335; 5,064,413; 4,941,880; 4,790,824 or 4,596,556. Such needleless devices comprising the pharmaceutical composition are also part of the present invention. The pharmaceutical compositions disclosed herein may also be administered by infusion. Examples of well-known implants and modules for administering the pharmaceutical compositions include those disclosed in: U.S. Pat. No. 4,487,603, which discloses an implantable micro-infusion pump for dispensing medication at a controlled rate; U.S. Pat. No. 4,447,233, which discloses a medication infusion pump for delivering medication at a precise infusion rate; U.S. Pat. No. 4,447,224, which discloses a variable flow implantable infusion apparatus for continuous drug delivery; U.S. Pat. No. 4,439,196, which discloses an osmotic drug delivery system having multi-chamber compartments. Many other such implants, delivery systems, and modules are well known to those skilled in the art and those comprising the pharmaceutical compositions of the present invention are within the scope of the present invention.

Alternately, one may administer the anti-LAG3 antibody (e.g., humanized antibody such as antagonist humanized antibodies) or antigen-binding fragment (e.g., 4A10, 19E8, 11C9 and/or 22D2; e.g., Ab1, Ab2, Ab3, Ab4, Ab5, Ab6, Ab7, Ab8 and/or Ab9) in a local rather than systemic manner, for example, via injection of the antibody or fragment directly into a tumor, e.g., a $LAG3^+$ tumor. Furthermore, one may administer the antibody or fragment in a targeted drug delivery system, for example, in a liposome coated with a tissue-specific antibody, targeting, for example, a tumor e.g., a $LAG3^+$ tumor, e.g., characterized by immunopathology. The liposomes will be targeted to and taken up selectively by the afflicted tissue. Such methods and liposomes are part of the present invention.

"Treat" or "treating" means to administer anti-LAG3 antibodies or antigen-binding fragments thereof of the present invention, to a subject having one or more symptoms of a disease for which the anti-LAG3 antibodies and antigen-binding fragments are effective, e.g., in the treatment of a subject having cancer or an infectious disease, or being suspected of having cancer or infectious disease, for which the agent has therapeutic activity. Typically, the antibody or fragment is administered in an "effective amount" or "effective dose" which will alleviate one or more symptoms (e.g., of cancer or infectious disease) in the treated subject or population, whether by inducing the regression or elimination of such symptoms or by inhibiting the progression of such symptom(s), e.g., cancer symptoms such as tumor growth or metastasis, by any clinically measurable degree. The effective amount of the antibody or fragment may vary according to factors such as the disease stage, age, and weight of the patient, and the ability of the drug to elicit a desired response in the subject.

Antibodies (e.g., humanized antibodies such as antagonist humanized antibodies) or antigen-binding fragments thereof disclosed herein (e.g., 4A10, 19E8, 11C9 and/or 22D2; e.g., Ab1, Ab2, Ab3, Ab4, Ab5, Ab6, Ab7, Ab8 and/or Ab9) may be provided by continuous infusion, or by doses administered, e.g., daily, 1-7 times per week, weekly, bi-weekly, monthly, bimonthly, quarterly, semiannually, annually etc. Doses may be provided, e.g., intravenously, subcutaneously, topically, orally, nasally, rectally, intramuscular, intracerebrally, intraspinally, or by inhalation. An effective dose of an anti-LAG3 antibody or antigen-binding fragment thereof of the present invention, is from about 0.1 mg/kg (body weight) to about 100 mg/kg (body weight), e.g., for treatment or prevention of cancer or infectious diseases. In an embodiment of the invention, an effective dose for treatment of a medical condition, wherein overexpression of LAG3 occurs, is the dose at which complete saturation of the LAG3 antigen occurs in the body of the subject, e.g., on T-cells within tumors of the subject or wherein there is about 10% saturation or more than about 10%.

Determination of the appropriate dose is made by the clinician, e.g., using parameters or factors known or suspected in the art to affect treatment. Generally, in determining the dose, the dose begins with an amount somewhat less than the optimum dose and it is increased by small increments thereafter until the desired or optimum effect is achieved relative to any negative side effects. Important diagnostic measures include those of symptoms of, e.g., the inflammation or level of inflammatory cytokines produced. In general, it is desirable that a biologic that will be used is derived from the same species as the animal targeted for treatment, thereby minimizing any immune response to the reagent. In the case of human subjects, for example, chimeric, humanized and fully human antibodies are may be desirable. Guidance in selecting appropriate doses of anti-LAG3 antibodies or fragments is available (see, e.g., Wawrzynczak (1996) Antibody Therapy, Bios Scientific Pub. Ltd, Oxfordshire, UK; Kresina (ed.) (1991) Monoclonal Antibodies, Cytokines and Arthritis, Marcel Dekker, New York, N.Y.; Bach (ed.) (1993) Monoclonal Antibodies and Peptide Therapy in Autoimmune Diseases, Marcel Dekker, New York, N.Y.; Baert et al. (2003) New Engl. J. Med. 348:601-608; Milgrom et al. (1999) New Engl. J. Med. 341:1966-1973; Slamon et al. (2001) New Engl. J. Med. 344:783-792; Beniaminovitz et al. (2000) New Engl. J. Med. 342:613-619; Ghosh et al. (2003) New Engl. J. Med. 348:24-32; Lipsky et al. (2000) New Engl. J. Med. 343:1594-1602).

Whether a disease symptom has been alleviated can be assessed by any clinical measurement typically used by physicians or other skilled healthcare providers to assess the severity or progression status of that symptom. While an embodiment of the present invention (e.g., a treatment method or article of manufacture) may not be effective in alleviating the target disease symptom(s) in every subject, it should alleviate the target disease symptom(s) in a statistically significant number of subjects as determined by any statistical test known in the art such as the Student's t-test, the chi$^2$-test, the U-test according to Mann and Whitney, the Kruskal-Wallis test (H-test), Jonckheere-Terpstra-test and the Wilcoxon-test.

Kits

Further provided are kits comprising one or more components that include, but are not limited to, an anti-LAG3 antibody (e.g., humanized antibody such as antagonist humanized antibodies) or antigen-binding fragment, as discussed herein (e.g., 4A10, 19E8, 11C9 and/or 22D2; e.g., Ab1, Ab2, Ab3, Ab4, Ab5, Ab6, Ab7, Ab8 and/or Ab9) in association with one or more additional components including, but not limited to, a further therapeutic agent, as discussed herein. The antibody or fragment and/or the therapeutic agent can be formulated as a pure composition or in combination with a pharmaceutically acceptable carrier, in a pharmaceutical composition.

In one embodiment, the kit includes an anti-LAG3 antibody (e.g., humanized antibody such as antagonist humanized antibodies) or antigen-binding fragment thereof of the invention (e.g., 4A10, 19E8, 11C9 and/or 22D2; e.g., Ab1, Ab2, Ab3, Ab4, Ab5, Ab6, Ab7, Ab8 and/or Ab9) or a pharmaceutical composition thereof in one container (e.g., in a sterile glass or plastic vial) and a further therapeutic agent in another container (e.g., in a sterile glass or plastic vial).

In another embodiment, the kit comprises a combination of the invention, including an anti-LAG3 antibody (e.g., humanized antibody such as antagonist humanized antibodies) or antigen-binding fragment thereof of the invention (e.g., 4A10, 19E8, 11C9 and/or 22D2; e.g., Ab1, Ab2, Ab3, Ab4, Ab5, Ab6, Ab7, Ab8 and/or Ab9) or pharmaceutical composition thereof in combination with one or more therapeutic agents formulated together, optionally, in a pharmaceutical composition, in a single, common container.

If the kit includes a pharmaceutical composition for parenteral administration to a subject, the kit can include a device for performing such administration. For example, the kit can include one or more hypodermic needles or other injection devices as discussed above. Thus, the present invention includes a kit comprising an injection device and the anti-LAG3 antibody or antigen-binding fragment thereof of the present invention, e.g., wherein the injection device includes the antibody or fragment or wherein the antibody or fragment is in a separate vessel.

The kit can include a package insert including information concerning the pharmaceutical compositions and dosage forms in the kit. Generally, such information aids patients and physicians in using the enclosed pharmaceutical compositions and dosage forms effectively and safely. For example, the following information regarding a combination of the invention may be supplied in the insert: pharmacokinetics, pharmacodynamics, clinical studies, efficacy parameters, indications and usage, contraindications, warnings, precautions, adverse reactions, overdosage, proper dosage and administration, how supplied, proper storage conditions, references, manufacturer/distributor information and patent information.

Detection Kits and Therapeutic Kits

As a matter of convenience, an anti-LAG3 antibody (e.g., humanized antibody such as antagonist humanized antibodies) or antigen-binding fragment thereof of the invention (e.g., 4A10, 19E8, 11C9 and/or 22D2; e.g., Ab1, Ab2, Ab3, Ab4, Ab5, Ab6, Ab7, Ab8 and/or Ab9) can be provided in a kit, i.e., a packaged combination of reagents in predetermined amounts with instructions for performing the diagnostic or detection assay. Where the antibody or fragment is labeled with an enzyme, the kit will include substrates and cofactors required by the enzyme (e.g., a substrate precursor which provides the detectable chromophore or fluorophore). In addition, other additives may be included such as stabilizers, buffers (e.g., a block buffer or lysis buffer) and the like. The relative amounts of the various reagents may be varied widely to provide for concentrations in solution of the reagents which substantially optimize the sensitivity of the assay. Particularly, the reagents may be provided as dry powders, usually lyophilized, including excipients which on dissolution will provide a reagent solution having the appropriate concentration.

Also provided are diagnostic or detection reagents and kits comprising one or more such reagents for use in a variety of detection assays, including for example, immunoassays such as ELISA (sandwich-type or competitive format). The kit's components may be pre-attached to a solid support, or may be applied to the surface of a solid support when the kit is used. In some embodiments of the invention, the signal generating means may come pre-associated with an antibody or fragment of the invention or may require combination with one or more components, e.g., buffers, antibody-enzyme conjugates, enzyme substrates, or the like, prior to use. Kits may also include additional reagents, e.g., blocking reagents for reducing nonspecific binding to the solid phase surface, washing reagents, enzyme substrates, and the like. The solid phase surface may be in the form of a tube, a bead, a microtiter plate, a microsphere, or other materials suitable for immobilizing proteins, peptides, or polypeptides. In particular aspects, an enzyme that catalyzes the formation of a chemilluminescent or chromogenic product or the reduction of a chemilluminescent or chromogenic substrate is a component of the signal generating means. Such enzymes are well known in the art. Kits may comprise any of the capture agents and detection reagents described herein. Optionally the kit may also comprise instructions for carrying out the methods of the invention.

Also provided is a kit comprising an anti-LAGS antibody (e.g., humanized antibody such as antagonist humanized antibodies) or antigen-binding fragment thereof packaged in a container, such as a vial or bottle, and further comprising a label attached to or packaged with the container, the label describing the contents of the container and providing indications and/or instructions regarding use of the contents of the container to treat one or more disease states as described herein.

In one aspect, the kit is for treating cancer and comprises an anti-LAG3 antibody (e.g., humanized antibody such as antagonist humanized antibodies) or antigen-binding fragment thereof and a further therapeutic agent or a vaccine. The kit may optionally further include a syringe for parenteral, e.g., intravenous, administration. In another aspect, the kit comprises an anti-LAG3 antibody (e.g., humanized antibody such as antagonist humanized antibodies) or antigen-binding fragment thereof and a label attached to or packaged with the container describing use of the antibody or fragment with the vaccine or further therapeutic agent. In yet another aspect, the kit comprises the vaccine or further therapeutic agent and a label attached to or packaged with the container describing use of the vaccine or further therapeutic agent with the anti-LAG3 antibody or fragment. In certain embodiments, an anti-LAG3 antibody and vaccine or further therapeutic agent are in separate vials or are combined together in the same pharmaceutical composition.

As discussed above in the combination therapy section, concurrent administration of two therapeutic agents does not require that the agents be administered at the same time or by the same route, as long as there is an overlap in the time period during which the agents are exerting their therapeutic effect. Simultaneous or sequential administration is contemplated, as is administration on different days or weeks.

The therapeutic and detection kits disclosed herein may also be prepared that comprise at least one of the antibody, peptide, antigen-binding fragment, or polynucleotide disclosed herein and instructions for using the composition as a detection reagent or therapeutic agent. Containers for use in such kits may typically comprise at least one vial, test tube, flask, bottle, syringe or other suitable container, into which one or more of the detection and/or therapeutic composition(s) may be placed, and preferably suitably aliquoted. Where a second therapeutic agent is also provided, the kit may also contain a second distinct container into which this second detection and/or therapeutic composition may be placed. Alternatively, a plurality of compounds may be prepared in a single pharmaceutical composition, and may be packaged in a single container means, such as a vial, flask, syringe, bottle, or other suitable single container. The kits disclosed herein will also typically include a means for containing the vial(s) in close confinement for commercial sale, such as, e.g., injection or blow-molded plastic containers into which the desired vial(s) are retained. Where a radiolabel, chromogenic, fluorigenic, or other type of detectable label or detecting means is included within the kit, the labeling agent may be provided either in the same container as the detection or therapeutic composition itself, or may alternatively be placed in a second distinct container means into which this second composition may be placed and suitably aliquoted. Alternatively, the detection reagent and the label may be prepared in a single container means, and in most cases, the kit will also typically include a means for containing the vial(s) in close confinement for commercial sale and/or convenient packaging and delivery.

A device or apparatus for carrying out the detection or monitoring methods described herein is also provided. Such an apparatus may include a chamber or tube into which sample can be input, a fluid handling system optionally including valves or pumps to direct flow of the sample through the device, optionally filters to separate plasma or serum from blood, mixing chambers for the addition of capture agents or detection reagents, and optionally a detection device for detecting the amount of detectable label bound to the capture agent immunocomplex. The flow of sample may be passive (e.g., by capillary, hydrostatic, or other forces that do not require further manipulation of the device once sample is applied) or active (e.g., by application of force generated via mechanical pumps, electroosmotic pumps, centrifugal force, or increased air pressure), or by a combination of active and passive forces.

In further embodiments, also provided is a processor, a computer readable memory, and a routine stored on the computer readable memory and adapted to be executed on the processor to perform any of the methods described herein. Examples of suitable computing systems, environments, and/or configurations include personal computers, server computers, hand-held or laptop devices, multiprocessor systems, microprocessor-based systems, set top boxes, programmable consumer electronics, network PCs, minicomputers, mainframe computers, distributed computing environments that include any of the above systems or devices, or any other systems known in the art.

GENERAL METHODS

Standard methods in molecular biology are described Sambrook, Fritsch and Maniatis (1982 & 1989 $2^{nd}$ Edition, 2001 $3^{rd}$ Edition) *Molecular Cloning, A Laboratory Manual*, Cold Spring Harbor Laboratory Press, Cold Spring Harbor, N.Y.; Sambrook and Russell (2001) *Molecular Cloning*, $3^{rd}$ ed., Cold Spring Harbor Laboratory Press, Cold Spring Harbor, N.Y.; Wu (1993) *Recombinant DNA*, Vol. 217, Academic Press, San Diego, Calif.). Standard methods also appear in Ausbel, et al. (2001) *Current Protocols in Molecular Biology*, Vols. 1-4, John Wiley and Sons, Inc. New York, N.Y., which describes cloning in bacterial cells and DNA mutagenesis (Vol. 1), cloning in mammalian cells and yeast (Vol. 2), glycoconjugates and protein expression (Vol. 3), and bioinformatics (Vol. 4).

Methods for protein purification including immunoprecipitation, chromatography, electrophoresis, centrifugation, and crystallization are described (Coligan, et al. (2000) *Current Protocols in Protein Science*, Vol. 1, John Wiley and Sons, Inc., New York). Chemical analysis, chemical modification, post-translational modification, production of fusion proteins, glycosylation of proteins are described (see, e.g., Coligan, et al. (2000) *Current Protocols in Protein Science*, Vol. 2, John Wiley and Sons, Inc., New York; Ausubel, et al. (2001) *Current Protocols in Molecular Biology*, Vol. 3, John Wiley and Sons, Inc., NY, N.Y., pp. 16.0.5-16.22.17; Sigma-Aldrich, Co. (2001) *Products for Life Science Research*, St. Louis, Mo.; pp. 45-89; Amersham Pharmacia Biotech (2001) *BioDirectory*, Piscataway, N.J., pp. 384-391). Production, purification, and fragmentation of polyclonal and monoclonal antibodies are described (Coligan, et al. (2001) *Current Protocols in Immunology, Vol.* 1, John Wiley and Sons, Inc., New York; Harlow and Lane (1999) *Using Antibodies*, Cold Spring Harbor Laboratory Press, Cold Spring Harbor, N.Y.; Harlow and Lane, supra). Standard techniques for characterizing ligand/receptor interactions are available (see, e.g., Coligan, et al. (2001) *Current Protocols in Immunology, Vol.* 4, John Wiley, Inc., New York).

Monoclonal, polyclonal, and humanized antibodies can be prepared (see, e.g., Sheperd and Dean (eds.) (2000) *Monoclonal Antibodies*, Oxford Univ. Press, New York, N.Y.; Kontermann and Dubel (eds.) (2001) *Antibody Engineering*, Springer-Verlag, New York; Harlow and Lane (1988) *Antibodies A Laboratory Manual*, Cold Spring Harbor Laboratory Press, Cold Spring Harbor, N.Y., pp. 139-243; Carpenter, et al. (2000) *J. Immunol.* 165:6205; He, et al. (1998) *J. Immunol.* 160:1029; Tang et al. (1999) *J. Biol. Chem.* 274:27371-27378; Baca et al. (1997) *J. Biol. Chem.* 272:10678-10684; Chothia et al. (1989) *Nature* 342:877-883; Foote and Winter (1992) *J. Mol. Biol.* 224:487-499; U.S. Pat. No. 6,329,511).

An alternative to humanization is to use human antibody libraries displayed on phage or human antibody libraries in transgenic mice (Vaughan et al. (1996) *Nature Biotechnol.* 14:309-314; Barbas (1995) *Nature Medicine* 1:837-839; Mendez et al. (1997) *Nature Genetics* 15:146-156; Hoogenboom and Chames (2000) *Immunol. Today* 21:371-377; Barbas et al. (2001) *Phage Display: A Laboratory Manual*, Cold Spring Harbor Laboratory Press, Cold Spring Harbor, N.Y.; Kay et al. (1996) *Phage Display of Peptides and Proteins: A Laboratory Manual*, Academic Press, San Diego, Calif.; de Bruin et al. (1999) *Nature Biotechnol.* 17:397-399).

Single chain antibodies and diabodies are described (see, e.g., Malecki et al. (2002) *Proc. Natl. Acad. Sci. USA* 99:213-218; Conrath et al. (2001) *J. Biol. Chem.* 276:7346-7350; Desmyter et al. (2001) *J. Biol. Chem.* 276:26285-26290; Hudson and Kortt (1999) *J. Immunol. Methods* 231:177-189; and U.S. Pat. No. 4,946,778). Bifunctional antibodies are provided (see, e.g., Mack, et al. (1995) *Proc. Natl. Acad. Sci. USA* 92:7021-7025; Carter (2001) *J. Immunol. Methods* 248:7-15; Volkel, et al. (2001) *Protein Engineering* 14:815-823; Segal, et al. (2001) *J. Immunol. Methods* 248:1-6; Brennan, et al. (1985) *Science* 229:81-83; Raso, et al. (1997) *J. Biol. Chem.* 272:27623; Morrison (1985) *Science* 229:1202-1207; Traunecker, et al. (1991) *EMBO J.* 10:3655-3659; and U.S. Pat. Nos. 5,932,448, 5,532,210, and 6,129,914).

Bispecific antibodies are also provided (see, e.g., Azzoni et al. (1998) *J. Immunol.* 161:3493; Kita et al. (1999) *J. Immunol.* 162:6901; Merchant et al. (2000) *J. Biol. Chem.* 74:9115; Pandey et al. (2000) *J. Biol. Chem.* 275:38633; Zheng et al. (2001) *J. Biol Chem.* 276:12999; Propst et al. (2000) *J. Immunol.* 165:2214; Long (1999) *Ann. Rev. Immunol.* 17:875).

Purification of antigen is not necessary for the generation of antibodies. Animals can be immunized with cells bearing the antigen of interest. Splenocytes can then be isolated from the immunized animals, and the splenocytes can fused with a myeloma cell line to produce a hybridoma (see, e.g., Meyaard et al. (1997) *Immunity* 7:283-290; Wright et al. (2000) *Immunity* 13:233-242; Preston et al., supra; Kaithamana et al. (1999) *J. Immunol.* 163:5157-5164).

Antibodies can be conjugated, e.g., to small drug molecules, enzymes, liposomes, polyethylene glycol (PEG). Antibodies are useful for therapeutic, diagnostic, kit or other purposes, and include antibodies coupled, e.g., to dyes, radioisotopes, enzymes, or metals, e.g., colloidal gold (see, e.g., Le Doussal et al. (1991) *J. Immunol.* 146:169-175; Gibellini et al. (1998) *J. Immunol.* 160:3891-3898; Hsing and Bishop (1999) *J. Immunol.* 162:2804-2811; Everts et al. (2002) *J. Immunol.* 168:883-889).

Methods for flow cytometry, including fluorescence activated cell sorting (FACS), are available (see, e.g., Owens, et al. (1994) *Flow Cytometry Principles for Clinical Laboratory Practice*, John Wiley and Sons, Hoboken, N.J.; Givan (2001) *Flow Cytometry*, $2^{nd}$ ed.; Wiley-Liss, Hoboken, N.J.; Shapiro (2003) *Practical Flow Cytometry*, John Wiley and Sons, Hoboken, N.J.). Fluorescent reagents suitable for modifying nucleic acids, including nucleic acid primers and probes, polypeptides, and antibodies, for use, e.g., as diagnostic reagents, are available (Molecular Probes (2003) *Catalogue*, Molecular Probes, Inc., Eugene, Oreg.; Sigma-Aldrich (2003) *Catalogue*, St. Louis, Mo.).

Standard methods of histology of the immune system are described (see, e.g., Muller-Harmelink (ed.) (1986) *Human Thymus: Histopathology and Pathology*, Springer Verlag, New York, N.Y.; Hiatt, et al. (2000) *Color Atlas of Histology*, Lippincott, Williams, and Wilkins, Phila, P A; Louis, et al. (2002) *Basic Histology: Text and Atlas*, McGraw-Hill, New York, N.Y.).

Software packages and databases for determining, e.g., antigenic fragments, leader sequences, protein folding, functional domains, glycosylation sites, and sequence alignments, are available (see, e.g., GenBank, Vector NTI® Suite (Informax, Inc, Bethesda, Md.); GCG Wisconsin Package (Accelrys, Inc., San Diego, Calif.); DeCypher® (TimeLogic Corp., Crystal Bay, Nev.); Menne, et al. (2000) *Bioinformatics* 16: 741-742; Menne, et al. (2000) *Bioinformatics Applications Note* 16:741-742; Wren, et al. (2002) *Comput. Methods Programs Biomed.* 68:177-181; von Heijne (1983) *Eur. J. Biochem.* 133:17-21; von Heijne (1986) *Nucleic Acids Res.* 14:4683-4690).

EXAMPLES

These examples are intended to exemplify the present invention are not a limitation thereof. Compositions and methods set forth in the Examples form part of the present invention.

Example 1

Generation of Antibodies Against Human LAG3

To generate antibodies to human LAG3, Balb/C mice were immunized with 5 ug of human LAG3-hFc tagged recombinant protein using RIBI adjuvant and footpad injection on a biweekly schedule. Immunized mice were bled and serum titers determined for binding to human LAG3 transfected CHOK1 cells using a cell-based ELISA (described below). Mice with the highest titers were given a final boost with recombinant protein and draining popliteal lymph nodes isolated four days later. Hybridomas were generated by electrofusion of isolated lymphocytes with the myeloma fusion partner P3X63-AG8.653 using the Cytopulse Hybrimmune electrofusion system. Fused cells were plated in 96-well plates in DMEM/F12, 15% BCS, HAT, IL-6, OPI supplement, and gentamycin.

Hybridoma supernatants were assayed for binding to human LAG3 expressing CHOK1 cells and cross-reactivity to cynomolgus LAG3 expressing CHO cells using a cell-based ELISA format. Human LAG3 and cynomolgus LAG3 expressing CHO-K1 cells were plated in 96-well tissue-culture plates in 50 ul of DMEM/F12, 10% BCS and gentamycin (CHO-K1 media). Cells were plated at either $2\times10^4$ cells/well two days prior to the assay or $4\times10^4$ cells/well one day prior to the assay. Media was removed from the wells prior to the assay and 50 ul of hybridoma supernatant added. Hybridoma supernatants were incubated for 30-60 minutes at 37° C. and washed 3 times with PBS/0.05% Tween 20 using a cell ELISA washing protocol on the Biotek EL405x Select CW plate washer. Fifty microliters of the detection antibody, HRP-conjugated goat anti-mouse IgG (Southern Biotech cat#1031-05), was added at a 1:2000 dilution in CHO-K1 media and incubated at 37° C. for 30-60 minutes. Assay plates were washed as above and developed with TMB and stopped with TMB stop solution (KPL cat#50-85-06). The absorbance at 450 nm-620 nm was determined.

Positive hybridomas were subcloned by limiting dilution or subcloned by plating hybridomas in semi-solid media and clones picked on the ClonePix (Genetix). Final subclones were grown in small-scale cultures in serum-free hybridoma production medium and purified with protein G spin columns to generate purified antibody for further characterization. Purified antibodies from clones LB145.22D2.E1.1D1 (22D2), LB148.19E8.G1.1A1 (19E8), LB148.4A10.1H1 (4A10), and LB148.11C9.1C1 (11C9) were further characterized and $V_H$ and $V_L$ sequencing performed.

Example 2

Binding of Mouse Anti-LAG3 Antibodies to Human LAG3 and Cynomolgous Monkey LAG3 Expressed on the Surface of Chinese Hamster Ovary Cells Mouse anti-human LAG3 antibodies were tested for binding to human LAG3 and cynomolgus LAG3 expressing CHO-K1 cells using a cell-based ELISA. CHO-K1 cells were plated as described above and media removed prior to adding the test samples. Purified antibody from clones LB145.22D2.E1.1D1 (22D2), LB148.19E8.G1.1A1 (19E8), LB148.4A10.1H1 (4A10), and LB148.11C9.1C1 (11C9) were serially-diluted in DMEM/F12, 10% BCS (CHOK1 media) and added to the CHO-K1 plates. The samples were incubated at 37° C. for 30-60 minutes and plates were washed three times with PBS/0.05% Tween-20 using the cell wash program on the Biotek washer as described above. Binding was detected using an HRP-conjugated goat anti-mouse IgG (Southern Biotech cat#1031-05) secondary antibody added at a 1:2000 dilution in CHO-K1 media and incubated at 37° C. for 30-60 minutes. Assay plates were washed as above and developed with TMB and stopped with TMB stop solution (KPL cat#50-85-06). The absorbance at 450 nm-620 nm was determined. Representative binding curves for binding to human and cynomolgus LAG3 transfected CHO-K1 cells are in FIG. 1.

Example 3

Affinity Determination for Binding of Mouse Anti-LAG3 Antibodies to Human LAG3 Recombinant Protein The kinetic binding activity of mouse anti-human LAG3 clones LB148.19E8.G1.1A1, LB148.4A10.1H1, LB148.11C9.1C1 and LB145.22D2.E1.1D1 using human LAG3-His tagged recombinant protein was measured by surface plasmon resonance using a Biacore T200 system (Biacore, GE Healthcare, Piscataway, N.J.). Approximately 4000 RU of Goat Anti-Mouse IgG Fc gamma, Fragment Specific (Jackson ImmunoResearch Catalog #115-006-071, Lot 81313) was immobilized via amine coupling chemistry onto a Series S CM4 sensor chip, catalog number BR-1005-34. Mouse anti-human LAG3 clones listed above were injected over the immobilized goat anti-mouse surfaces at 1 ug/mL for a capture level of 40 RU. HBS-EP+ buffer (BR-1006-69) was used as the running buffer with a flow rate of 30 µL/min.

Varying concentrations of human LAG3-His protein ranging from 0.15 nM to 18.8 nM, at a flow rate of 40 µL/min were injected over the antibody surfaces. Following each injection cycle, the Series S CM4 chip surface was regenerated using one six second injection of 10 mM Glycine pH 1.5 solution followed by an injection of 12.5 mM NaOH solution at a flow rate of 60 µL/min.

Background subtraction binding sensorgrams were used for analyzing the rate constant of association ($k_a$) and dissociation ($k_d$), and the equilibrium dissociation constant $K_D$. The resulting data sets were fitted with a 1:1 Langmuir Binding Model using the Biacore T200 evaluation software (version 2.0). Table 4 summarizes the affinities for the mouse anti-human LAG3 antibodies to recombinant human LAG3.

TABLE 4

Measurement of Affinity for Mouse anti-Human LAG3 Antibodies to Recombinant Human LAG3.

| Clone ID | ka1 (1/Ms) | kd1 (1/s) | $K_D$ (M) |
| --- | --- | --- | --- |
| LB145.22D2.E1.1D1 | 1.39E+07 | 3.84E−05 | 2.77E−12 |
| LB148.19E8.G1.1A1 | 7.43E+06 | 1.09E−04 | 1.47E−11 |
| LB148.11C9.1C1 | 1.31E+06 | 1.92E−03 | 1.47E−09 |
| LB148.4A10.1H1 | 1.25E+06 | 1.13E−04 | 9.03E−11 |

Moreover, Ab6 binding to human CD4, which is structurally related to LAG3, both having four extracellular Ig-like domains, was not detected by BiaCore of by FACS when CD4 was expressed on transfected L-cells.

Example 4

Effect of Anti-LAG3 Antibodies on Murine T-cell Hybridoma 3A9 Cells Expressing Human LAG3.

The ability of anti-LAG3 antibodies to enhance antigen-specific T cell activation was tested in a modified version of a previously described T cell activation assay (Workman et al., (2002) Eur. J. Immunol. 32:2255-2263).

A HEL peptide$_{48-63}$-specific mouse T cell hybridoma (3A9) was stimulated with a haplotype-matched, MHCII+, HEL peptide$_{48-63}$-pulsed B cell line (LK35.2) and IL-2 release was assessed as a readout for antigen-specific T cell activation. The 3A9 T cell response to HEL peptide$_{48-63}$-pulsed LK35.2 cells was dose-dependent.

3A9 T cell lines stably overexpressing mouse or human LAG3 were generated by retroviral transduction. We demonstrated that mouse MHC2 on LK35.2 cells can engage both human and mouse LAG3, resulting in a strong reduction of the antigen-specific IL-2 production, at suboptimal T cell activation concentrations. The maximal effect of LAG3 activity was observed when titrating HEL peptide$_{48-63}$ at a concentration of 31.2 nM. The inhibitory effect of LAG3 overexpression was not seen when using LK35.2 B cells pulsed with higher peptide doses (corresponding to >100 nM). Treating with 10 ug/ml of a commercially available mouse LAG3 antibody, C9B7W, we were able to rescue IL-2 to levels of the vector 3A9 cells.

To assess the effect of anti-LAG3 antibodies in this assay, mouse or human LAG3-overexpressing 3A9 T cells (100,000 per well) were pretreated with anti-LAG3 antibodies (serially diluted in 3-fold dilutions from 10 ug/ml) for 30 minutes at 37° C., and stimulated with LK35.2 cells (33,333 per well) pulsed for 30 minutes prior to co-culture with 31.2 nM HEL peptide$_{48-63}$. After stimulation for 24 h at 37° C. and 5.0% $CO_2$, IL-2 secretion was assessed in culture supernatants by mesoscale. Inhibition of LAG3 with an antagonist antibody restored T-cell function resulting in the rescue of IL-2 production in a dose-dependent manner. IL-2 production was not rescued when 3A9 cell were pre-treated with isotype control antibodies. The ability of LAG3 overexpression to suppress IL-2 secretion coupled with IL-2 rescue after treatment with anti-LAG3 antibody validates this assay as a robust screening tool. Table 5 lists the EC50s for IL-2 rescue using the hLAG3-3A9 system for the mouse anti-human LAG3 antibodies.

TABLE 5

Mouse anti-human LAG3 antibodies stimulate IL-2 production in the hLAG3-3A9 T cell system

| Clone ID | EC50 (nM) | EC50 (nM) |
|---|---|---|
| LB145.22D2.E1.1D1 | 1.06 | 1.65 |
| LB148.19E8.G1.1A1 | 1.74 | 1.83 |
| LB148.11C9.1C1 | 3.56 | 4.06 |
| LB148.4A10.1H1 | 2.83 | 2.96 |

Example 5

Blocking of LAG3/MHC Class II Binding on Daudi Cells

Mouse anti-human LAG3 clones were tested for their ability to block hLAG3 interaction with human MHC Class II. Daudi cells (ATCC #CCL-213) were used as a cell line positive for human MHC class II expression. Daudi cells were blocked with 10 ug/ml of goat IgG in HBSS and 2% BCS on ice for 30 minutes and $0.5 \times 10^6$ cells/sample were aliquoted into a 96-well V-bottom plate and blocking buffer removed. Clones LB145.22D2.E1.1D1, LB148.19E8.G1.1A1, LB148.4A10.1H1, and LB148.11C9.1C1 were serially diluted starting at 20 ug/ml in HBSS/2% BCS and pre-incubated with 2 ug/ml of human LAG3-huFc in 96-well polypropylene U-bottom plates in a final volume of 100 ul and incubated on ice for 30 minutes. Following pre-incubation, the human LAG3-Fc/hybridoma supernatant mixtures were added to the blocked Daudi cells and incubated for 45 minutes on ice. Cells were pelleted by centrifugation at 1200 rpm and washed twice with HBSS/2% BCS. Human LAG3-Fc binding to Daudi cells was detected using F(ab)'$_2$ goat anti-human IgG-PE conjugate (Southern Biotech Cat#) at 1:200 dilution in 100 ul staining volume and incubated on ice for 20 minutes. Cells were washed twice as described above, resuspended in HBSS/2% BCS and read on the FACSCalibur. Table 6 summarizes the IC50s for MHC class II blockade for the mouse anti-human LAG3 clones.

TABLE 6

Mouse anti-human LAG3 antibodies block the interaction of human MHC Class II with human LAG3-Fc recombinant protein.

| Clone ID | IC50 (nM) |
|---|---|
| LB145.22D2.E1.1D1 | 2.10 |
| LB148.19E8.G1.1A1 | 2.80 |
| LB148.11C9.1C1 | 2.00 |
| LB148.4A10.1H1 | 1.90 |

Example 6

Evaluation of Four Anti-Human LAG3 Parental Antibodies for Tissue Cross-Reactivity in Focused Set of Normal Human Tissues by Immunohistochemistry.

Frozen sections of a subset of normal human tissues (brain, heart, kidney, liver, lung, pancreas, pituitary) were stained using four anti-human LAG3 antibody clones (LB148.4A10.1H1 (4A10), LB148.11C9.1C1 (11C9), LB148.19E8.G1.1A1 (19E8), LB145.22D2. E1.1D1 (22D2)) as immunohistochemical reagents, in order to screen for potential unexpected tissue reactivity. Human tonsil was used as a positive staining control. Mouse IgG2a, IgG1, and IgG2b, hereafter "isotype control" antibodies, were run concurrent with the respective anti-human LAG3 clones on all tissues to serve as comparators for evaluation of non-specific labeling.

Immunohistochemical cross-reactivity testing of antibodies 4A10, 11C9, and 19E8 and 22D2 was performed in separate runs.

All slides were reviewed by a pathologist and immunohistochemical signal was scored on a 0-3 scale (0=negative, +1=low, +2=moderate, +3=high). Staining intensities and patterns were compared between test article and isotype control reagents. Test article staining was considered to be significant when the intensity substantially exceeded that of the isotype control or had a distinct, reproducible difference in distributional pattern within the tissue.

TABLE 7

| Lag3 clone 4A10 (5 ug/mL) | | | |
|---|---|---|---|
| Slide# Antibody | Tissue Identification (Human) | Test antibody | IgG2a isotype |
| Lag3 clone 4A10 5 ug/mL | D6414 B1 brain | +1 | +1 |
| Lag3 clone 4A10 5 ug/mL | D1106 B1 heart | +1 | +1 |
| Lag3 clone 4A10 5 ug/mL | D7462 B1 kidney | +1 | +1 |
| Lag3 clone 4A10 5 ug/mL | D7122 B1 liver | +2 | +2 |
| Lag3 clone 4A10 5 ug/mL | D7092 B1 lung | +1 | +1 |
| Lag3 clone 4A10 5 ug/mL | D5425 B1 pancreas | +2, exocrine cells | 0 |
| Lag3 clone 4A10 5 ug/mL Positive Control | D5745 B1 pituitary | +1 | +1 |
| Lag3 clone 4A10 5 ug/mL | D7530 B2 tonsil | +2 (Appropriate labeling) | +1 |

Positive labeling of pancreatic exocrine cells (approximately 20% of total population present) is only seen in the test antibody treated sample but is limited to the cytoplasm.

TABLE 8

Lag3 clone 11C9 (10 ug/mL)

| Slide# Antibody | Tissue Identification (Human) | Test antibody | IgG1 isotype |
|---|---|---|---|
| Lag3 clone 11C9 10 ug/mL | D6414 B1 brain | +1 | +1 |
| Lag3 clone 11C9 10 ug/mL | D1106 B1 heart | 0 | 0 |
| Lag3 clone 11C9 10 ug/mL | D7462 B1 kidney | 0 | 0 |
| Lag3 clone 11C9 10 ug/mL | D7122 B1 liver | +1 | +2 |
| Lag3 clone 11C9 10 ug/mL | D7092 B1 lung | 0 | 0 |
| Lag3 clone 11C9 10 ug/mL | D5425 B1 pancreas | 0 | 0 |
| Lag3 clone 11C9 10 ug/mL | D5745 B1 pituitary | 0 | 0 |
| Positive Control | | | |
| Lag3 clone 11C9 10 ug/mL | D7530 B2 tonsil | +2 (Appropriate labeling) | 0 |

All positive signal cited in tables (except in positive controls) is interpreted as artifactually associated with the procedure performed and is identical to, or stronger in the isotype control.

TABLE 9

Lag3 clone 19E8 (0.5 ug/mL)

| Slide# Antibody | Tissue Identification (Human) | Test antibody | IgG2b isotype |
|---|---|---|---|
| Lag3 clone 19E8 0.5 ug/mL | D6414 B1 brain | +1 (vascular smooth muscle) | 0 |
| Lag3 clone 19E8 0.5 ug/mL | D1106 B1 heart | +1 (vascular smooth muscle) | 0 |
| Lag3 clone 19E8 0.5 ug/mL | D7462 B1 kidney | +1 (vascular smooth muscle) | +1 |
| Lag3 clone 19E8 0.5 ug/mL | D7122 B1 liver | +1 (vascular smooth muscle) | +1 |
| Lag3 clone 19E8 0.5 ug/mL | D7092 B1 lung | 0 | +1 |
| Lag3 clone 19E8 0.5 ug/mL | D5425 B1 pancreas | +1 (vascular smooth muscle) | 0 |
| Lag3 clone 19E8 0.5 ug/mL | D5745 B1 pituitary | +1 (vascular smooth muscle) | 0 |
| Positive Control | | | |
| Lag3 clone 19E8 0.5 ug/mL | D7530 B2 tonsil | +3 (Appropriate labeling) | +1 |

Nonspecific labeling of vascular smooth muscle is only observed in the test antibody treated samples but is limited to sarcoplasm/cytoplasm.

TABLE 10

Lag3 clone 22D2 (10 ug/mL)

| Antibody | Tissue Identification (Human) | Test antibody | IgG2a isotype |
|---|---|---|---|
| Lag3 clone 22D2 10 ug/mL | D6414 B1 brain | +2 | +2 |
| Lag3 clone 22D2 10 ug/mL | D1106 B1 heart | +1 | +1 |
| Lag3 clone 22D2 10 ug/mL | D7462 B1 kidney | +2 | +2 |
| Lag3 clone 22D2 10 ug/mL | D7122 B1 liver | +1 | +2 |
| Lag3 clone 22D2 10 ug/mL | D7092 B1 lung | +2 | +2 |
| Lag3 clone 22D2 10 ug/mL | D5425 B1 pancreas | +1 | +1 |
| Lag3 clone 22D2 10 ug/mL | D5745 B1 pituitary | +2 | +2 |
| Positive Control | | | |
| Lag3 clone 22D2 10 ug/mL | D7530 B2 tonsil | +3 (Appropriate labeling) | +2 |

All positive signal cited in tables (except in positive controls) is interpreted as artifactually associated with the procedure performed and is identical to, or stronger in the isotype control.

In conclusion, clone 19E8 exhibited relatively prominent sarcoplasmic labeling of vascular smooth muscle in all tissues examined except lung. Clone 4A10 exhibited cytoplasmic immunohistochemical reactivity in approximately 20% of pancreatic exocrine glandular cells. Clones 11C9 and 22D2 demonstrated no labeling beyond that observed with isotype control.

Example 7

Binding of Lag3 Clones to T Cells Isolated from Human and Cynomolgous Monkey Blood Binding of Lag3 mAb clones to primary T-cells was accessed using human and cynomolgous monkey (cyno) peripheral blood mononuclear cells (PBMC). Human blood was obtained from the local donors; cyno blood was obtained from Bioreclamation. PBMC were isolated from the whole blood using Ficoll-Paque Plus (GE Healthcare, Cat#17-1440-03) density gradient centrifugation at 524×g for 40 minutes. PBMC were collected from the medium:plasma interface and washed 2 times with phosphate buffered saline (PBS). The residual red blood cells were lysed using ammonium-chloride-potassium red blood cell lysing solution (ACK, GIBCO, cat# A10492-010). Cynomolgus monkey or human PBMC ($3 \times 10^6$/ml) were stimulated with 4 µg/ml PHA (Sigma, L2769) for 48 h and 20 h, respectively. For flow cytometric analysis, $1 \times 10^6$ PHA-activated PBMCs were used per staining in 50 µl FACS staining buffer (BD, cat#554657). Lag3 mAb clones or correspondent isotype controls (Table 11) were incubated with human or cyno PBMS followed by detection using goat anti-mouse IgG-PE (BD 550589). Mouse anti-human CD3-pacific blue (BD 558124, clone SP34-2), mouse anti-human CD4-PerCP (BD 550631, clone L200), and mouse anti-human CD8-APC-Cy7 (BD 557834, clone SK1) were used as phenotypic markers. Sample acquisition was performed on an LSR II flow cytometer and the data were analyzed using FlowJo software version 10.0.6 (Tree Star, Inc.).

Figure 2:
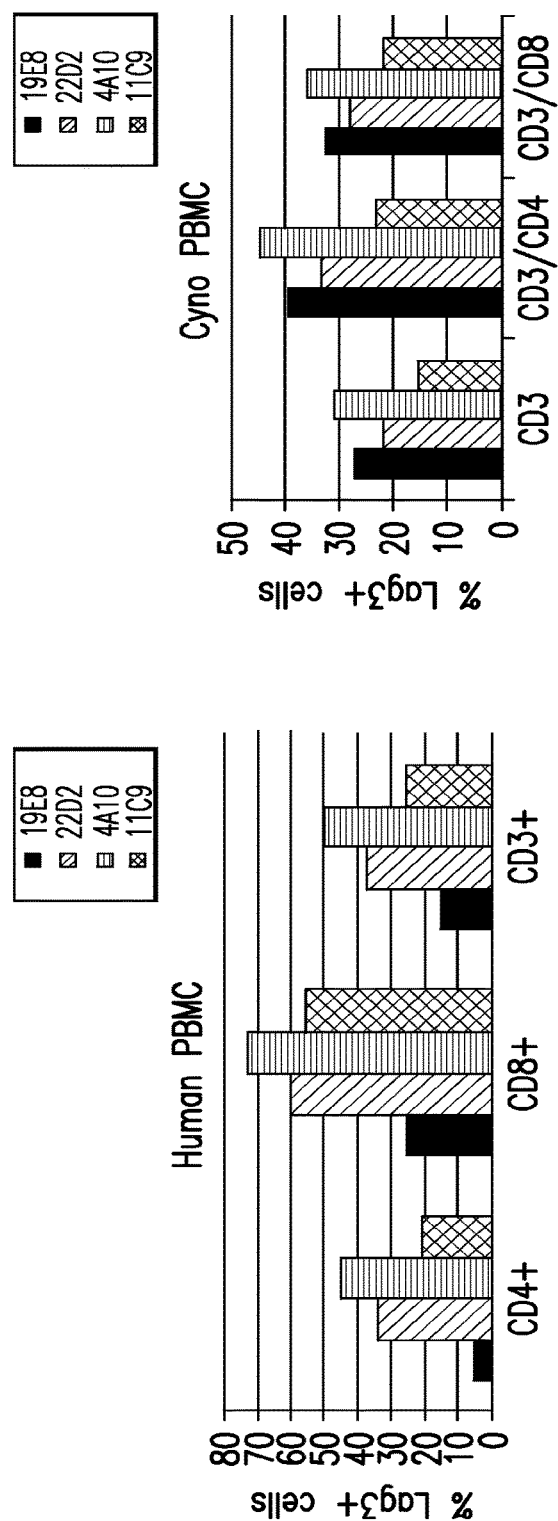
FIG. 2. Binding of LAG3 clones to cynomolgous monkey and human primary T-cells.

Flow cytometry analysis revealed binding to all the analyzed Lag3 clones to primary human and cyno T cells (representative data shown on FIG. 2).

TABLE 11

Lag 3 clones and isotype controls utilized in the study

| | | | |
|---|---|---|---|
| TC31.3E1.C7 | 28ACM | mIgG2a/K | 10 mM NaPhosphate, 75 mM NaCl, 3% sucrose, pH 7.3 |
| TC31.27F11.C2 | 64AFW | mIgG1/K | 10 mM phosphate, 75 mM NaCl, 3% sucrose pH 7.4 |
| KM9.LP1.MAB3 | 63ADP | mIgG2b/K | 20 mM NaAcetate, 7% sucrose, pH 5.5 |
| In house Lag3 | lot# | isotype | formulation |
| LB148.19E8.G1.1A1 | 42AGF | mIgG2b/K | 10 mM PO4, 75 mM NaCl, 3% sucrose pH 7.4 |
| LB145.22D2.E1.1D1 | 98AGF | mIgG2a/K | 10 mM PO4, 75 mM NaCl, 3% sucrose pH 7.4 |
| LB148.4A10.1H1 | 45AGF | mIgG2a/K | 10 mM PO4, 75 mM NaCl, 3% sucrose pH 7.4 |
| LB148.11C9.1C1 | 47AGF | mIgG1/K | 20 mM NaAc, 9% sucrose pH 5.0 |

Example 8

Epitope Mapping of hLAG3 Antibodies by Hydrogen Deuterium Exchange Mass Spectrometry Contacts between anti-LAG3 antibodies and human LAG3 were determined by use of hydrogen deuterium exchange mass spectrometry analysis.

Materials

Human LAG3-His:[VEGF leader]-LAG3_H-[His9G]

(SEQ ID NO: 447)
(LQPGAEVPVVWAQEGAPAQLPCSPTIPLQDLSLLRRAGVTWQHQPDSGP

PAAAPGHPLAPGPHPAAPSSWGPRPRRYTVLSVGPGGLRSGRLPLQPRVQ

LDERGRQRGDFSLWLRPARRADAGEYRAAVHLRDRALSCRLRLRLGQASM

TASPPGSLRASDWVILNCSFSRPDRPASVHWFRNRGQGRVPVRESPHHHL

AESFLFLPQVSPMDSGPWGCILTYRDGFNVSIMYNLTVLGLEPPTPLTVY

AGAGSRVGLPCRLPAGVGTRSFLTAKWTPPGGGPDLLVTGDNGDFTLRLE

DVSQAQAGTYTCHIHLQEQQLNATVTLAIITVTPKSFGSPGSLGKLLCEV

TPVSGQERFVWSSLDTPSQRSFSGPWLEAQEAQLLSQPWQCQLYQGERLL

GAAVYFTELSSPGAQRSGRAPGALPAGHLLHHHHHHHHGGQ)

Anti-hLAG3 clone 22D2 (chimeric antibody comprising the [LAG3_H] mAb (LB145.22D2.E1.D1 (VH0/VL0) Geneart) IgG4 S228P/kappa (PX) and the human IgG4 framework containing the hinge stabilizing S228P mutation)

Anti-hLAG3 clone 11C9 (mouse×[LAG3_H] mAb (LB148.11C9.1C1) IgG1/kappa (HY)/mouse IgG1)

Anti-hLAG3 clone 4A10 (mouse×[LAG3_H] mAb (LB148.4A10.1H1) IgG2a/kappa (HY)/mouse IgG2a)

Liquid Chromatography-Mass Spectrometry

The mass spectrometer was a Thermo Scientific Orbitrap-Velos. For the measurement of deuterium labeled samples, the mass spectrometer was set to acquire one full scan MS data in the orbitrap at 60,000 resolving power, a target ion count of 1E6 and a maximum ion injection time of 500 millisecond. For the acquisition of MS/MS data for peptide identifications, the mass spectrometer was set to acquire one full scan spectrum at 60,000 resolving power followed by ten data-dependent MS/MS spectra in the ion trap.

The liquid chromatography system was a Waters nano-Acquity for the analytical column gradient and a Waters 515 isocratic pump for the sample digestion and loading. For sample digestion and loading, the buffer used was 2% acetonitrile and 0.05% trifluoroacetic acid at a flow rate of 80 ul/min. For the analytical gradient, the buffers were Buffer A) 0.1% formic acid in water and Buffer B) 0.1% formic acid in acetonitrile.

The gradient was at 40 ul/min from 2% B to 36% B in 10 minutes, followed by a wash of 80% B for 1.5 minute and a reequilibration at 2% B for 3 minutes. The column was then washed by cycling the gradient between 2% and 80% B, three times with 1 minute at each step, followed by a final equilibration at 2% B for 5 minutes. The trapping column was a Waters Vanguard C18 BEH 1.7 um Guard Column and the analytical column was a Waters C18 BEH300, 1.7 um 1×50 mm column.

Sample handling for the deuterium labeling was done by a Leaptec H/D-X PAL system. The labeling sample tray was set to a temperature of 25° C., the quenching tray was set to 1.5° C. and the trap and analytical column chamber was set to 1.5° C. The immobilized pepsin column (Porosyme Immobilized Pepsin 2.1×30 mmm, Life Technologies) was kept outside the column chamber at room temperature.

Deuterium Labeling

For the antibody clones 22D2 and 11C9, hLAG3-His (113 pmol/ul) was mixed with an equal volume of the antibody (55 pmol/ul) or, as the unbound control, PBS pH 7.6. The antibody bound samples and the unbound control were incubated at room temperature for 1 hour before beginning the labeling experiment. For 4A10, the antibody (30 pmol/ul) was mixed with hLAG3-His at a 2:1 v/v ratio. Subsequent steps were identical for all the samples.

To deuterium label the samples, 2 ul of sample was mixed with 25 ul of PBS in deuterium oxide pD 7.6. Labeling time points were 30, 300, 3000 or 9000 seconds. After the set time, 25 ul of the labeling mixture was added to 40 ul of cold quench buffer (8M Urea, 100 mM TCEP, 0.02% dodecylmaltoside). The quenched sample was incubated at 1.5° C. for 2 minutes. 55 ul was then injected into the column cooling chamber where the sample was passed over the pepsin column and the resulting peptides loaded onto the trapping column. After three minutes, the analytical gradient and the mass spectrometer were started.

A fully deuterated sample was generated by incubating 2 ul of hLAG3 with 108 ul of deuterated denaturing buffer (4M Urea, 100 mM TCEP, 0.01% DDM in 99.5% deuterium oxide). The sample was incubated at 37° C. overnight. 55 ul was then directly injected into the column chamber and the data acquired as before.

Data Analysis

LC-MS/MS data was acquired of an unlabeled sample and searched before deuterium labeling to verify successful digestion of the proteins and to generate a list of peptides. Data was database searched using Proteome Discoverer 1.4 and the SEQUEST HT search algorithm (ThermoFisher Scientific). The protein database used was the human LAG5-His sequence concatenated to the yeast *Saccharomyces cerevisiae* database.

MS data from the deuterium labeling experience was processed by HDExaminer (Sierra Analytics). The mass and retention time selected by the software for each peptide was verified manually.

Results

Figure 3:
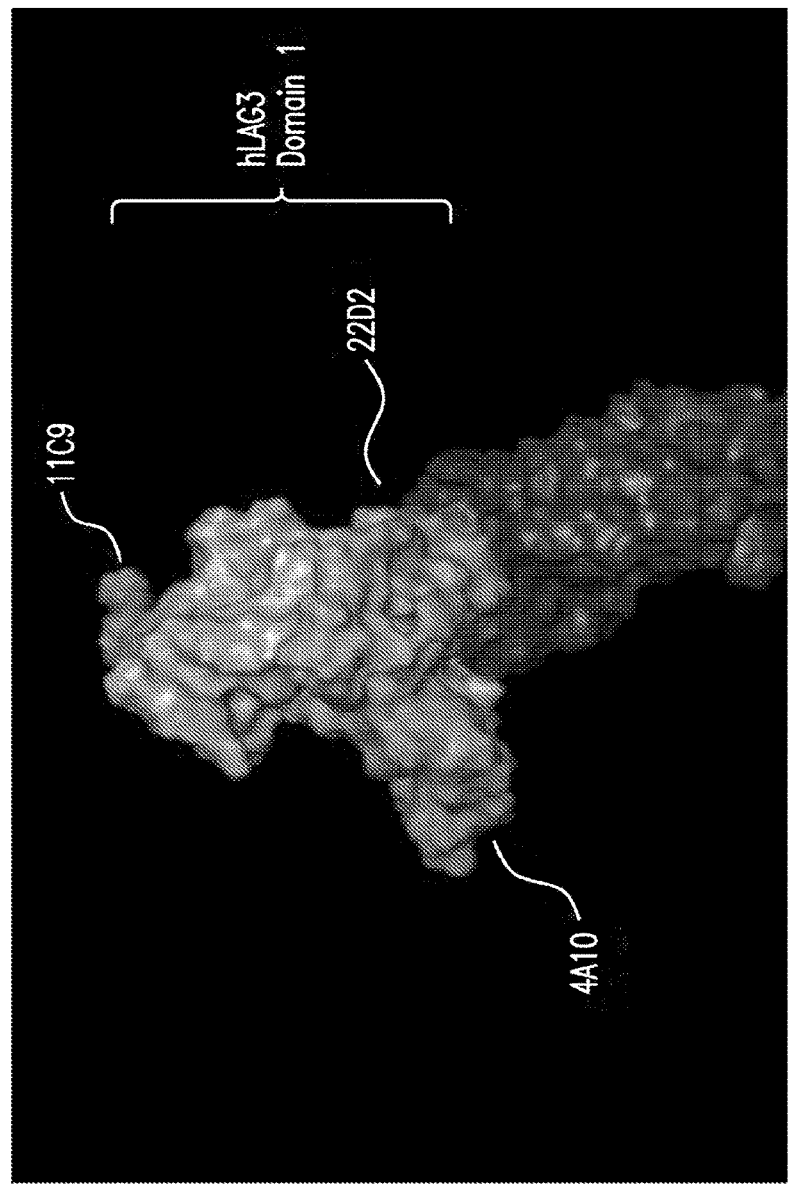
FIG. 3. Three-dimensional structure of human LAG3. The location of the antibody 22D2, 11C9 and 4A10 epitopes are indicated.
Figure 4A:
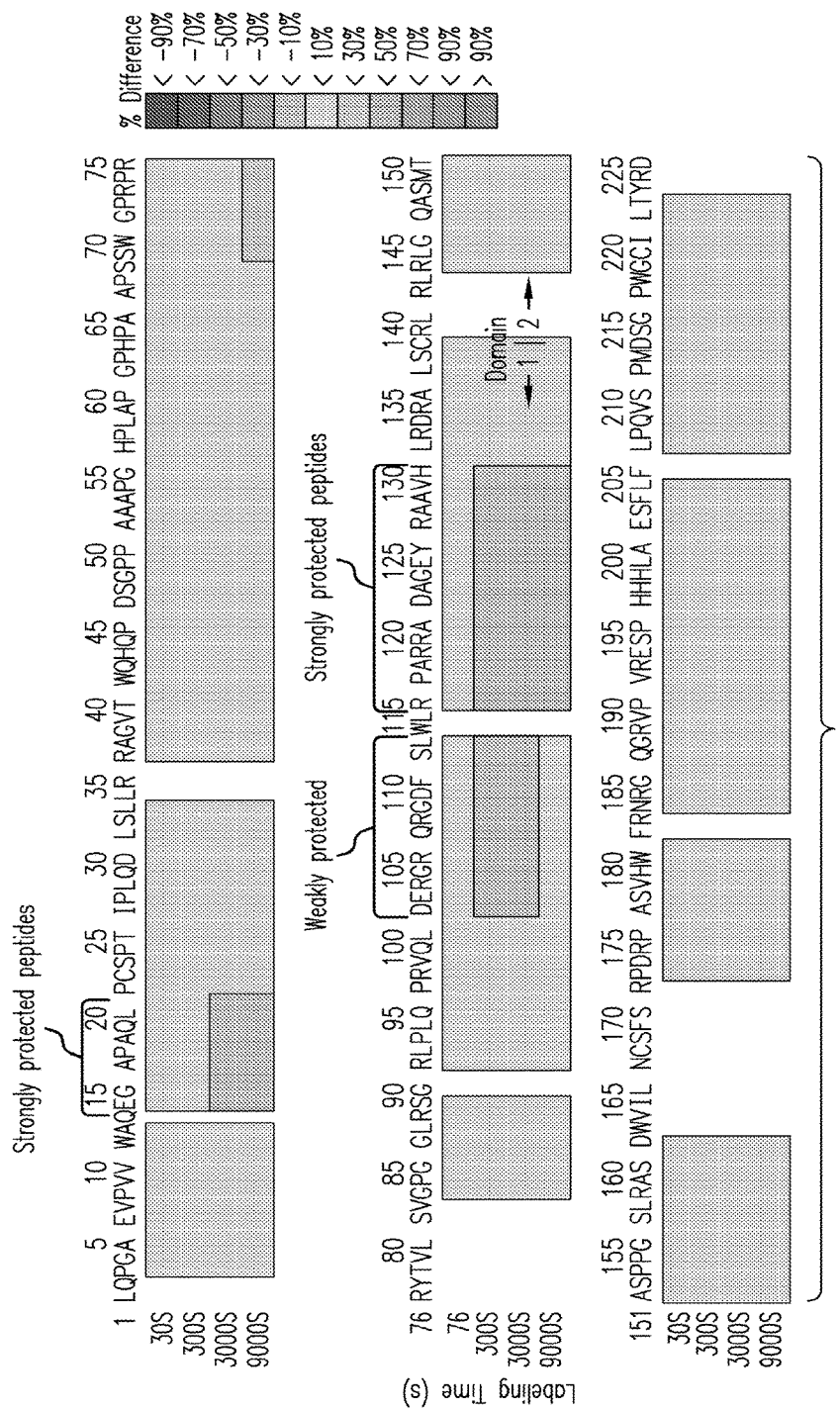
FIG. 4 (*a-c*1). Heat map indicating regions in human LAG3 which are strongly or weakly protected from deuteration by antibody binding. (a) and (a-1) human LAG3/22D2 Difference heatmap; (b) and (b-1) human LAG3/11C9 Difference heatmap; (c) and (c-1) human LAG3/4A10 Difference heatmap.
Figures 1, 4A:
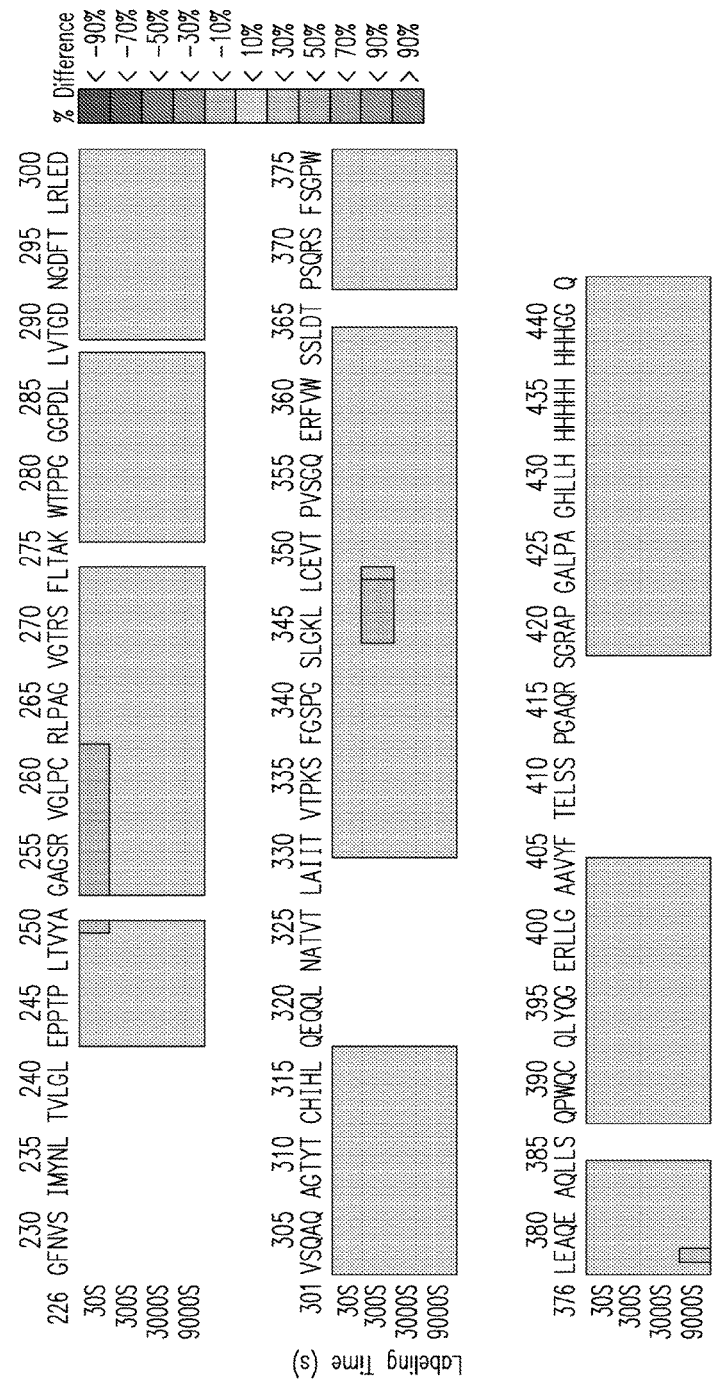
Figure 4B:
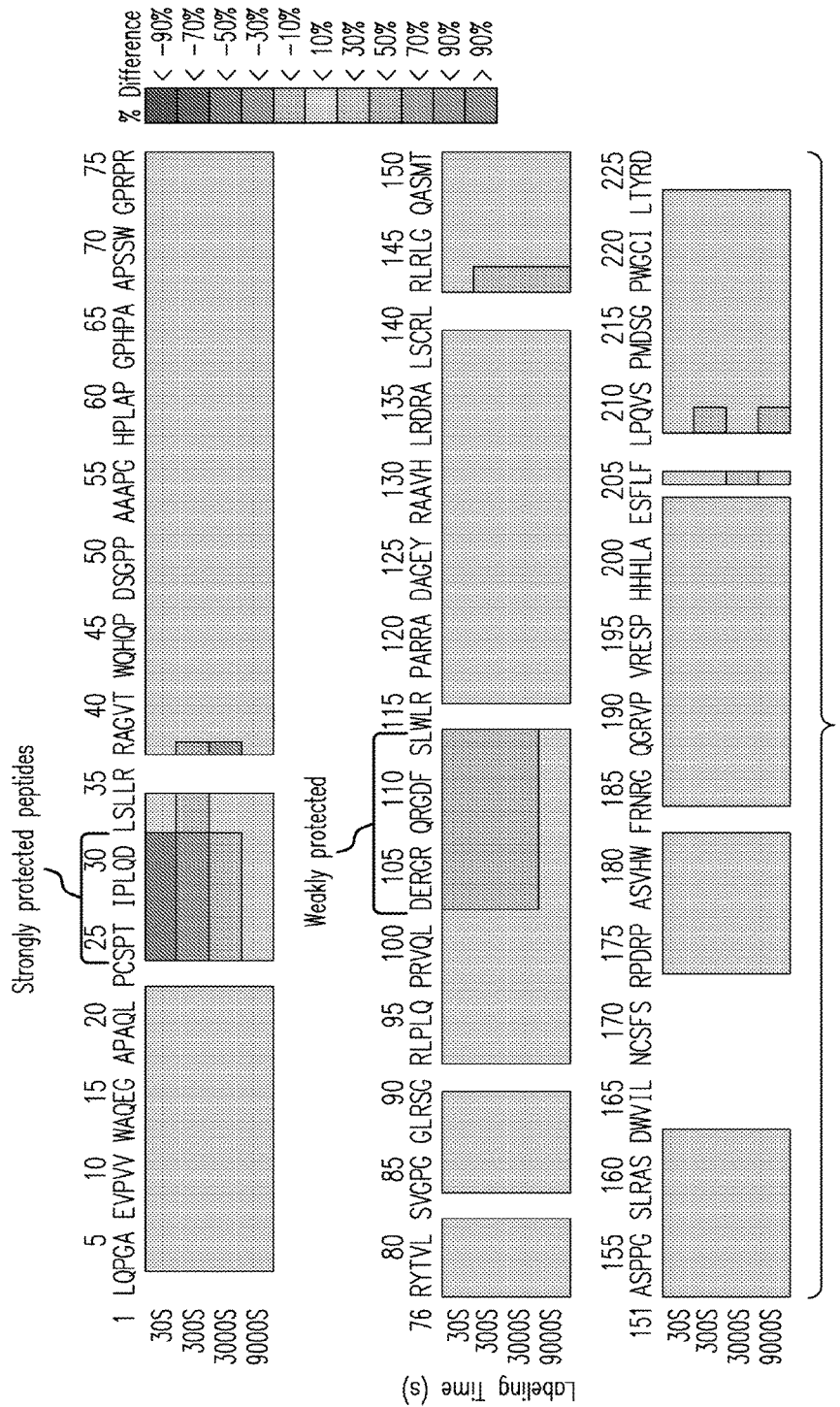
Figures 1, 4B:
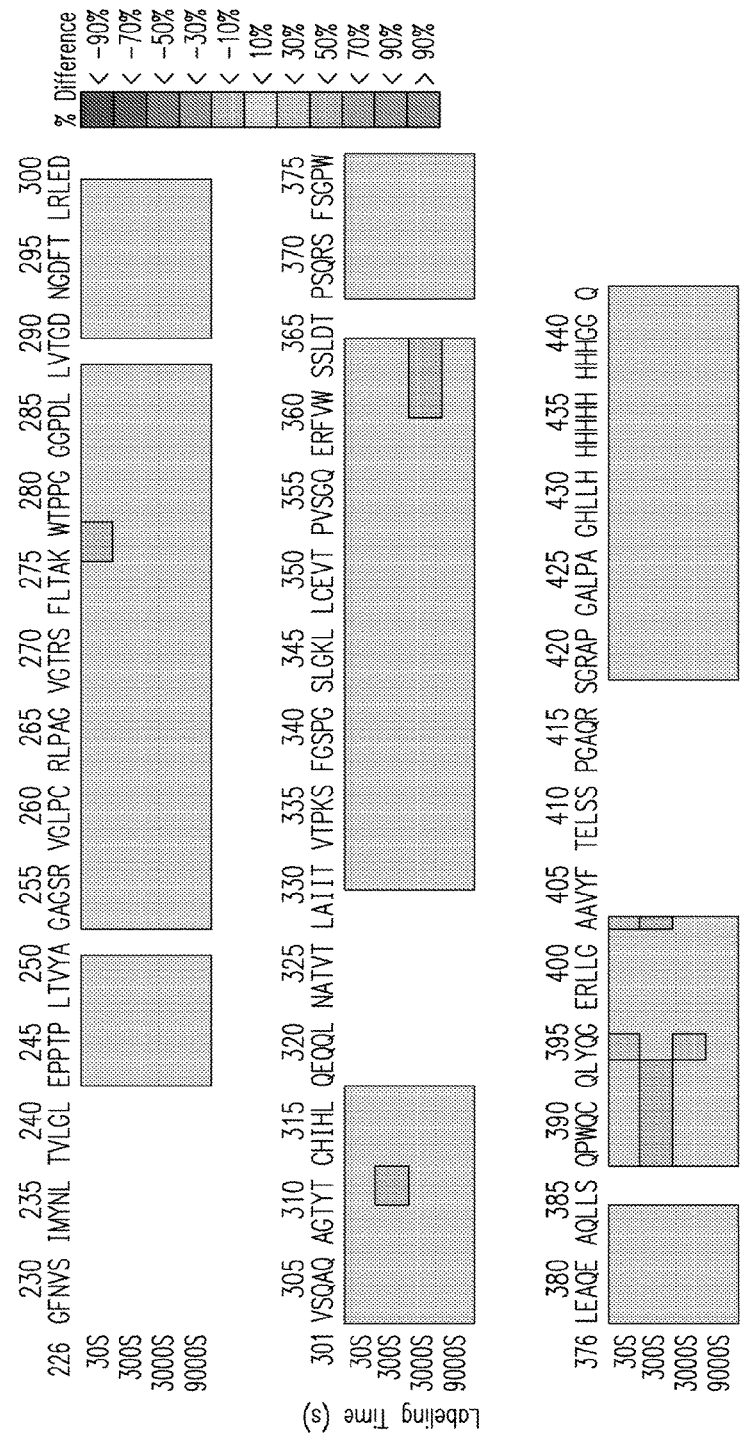
Figure 4C:
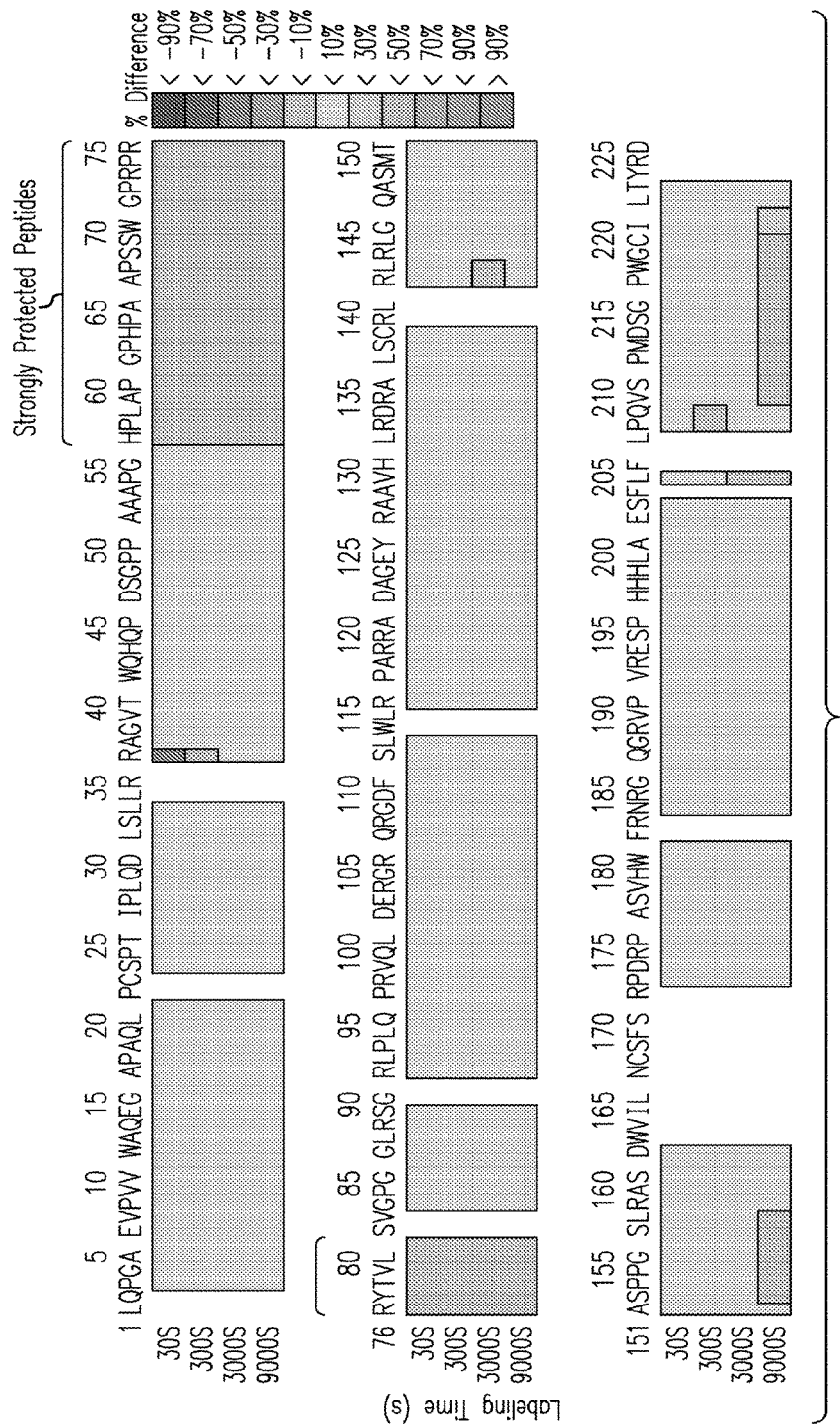
Figures 1, 4C:
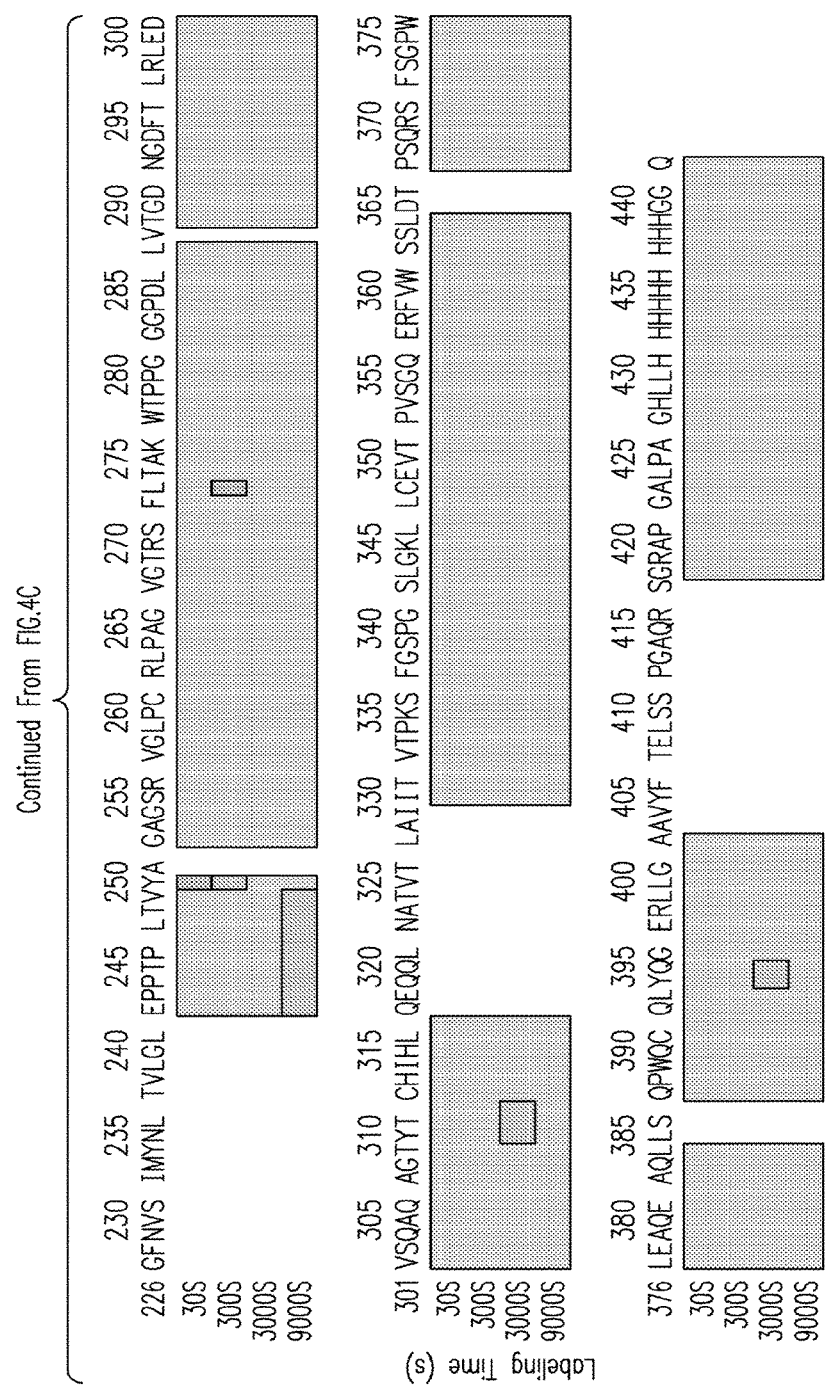
Figure 5A:
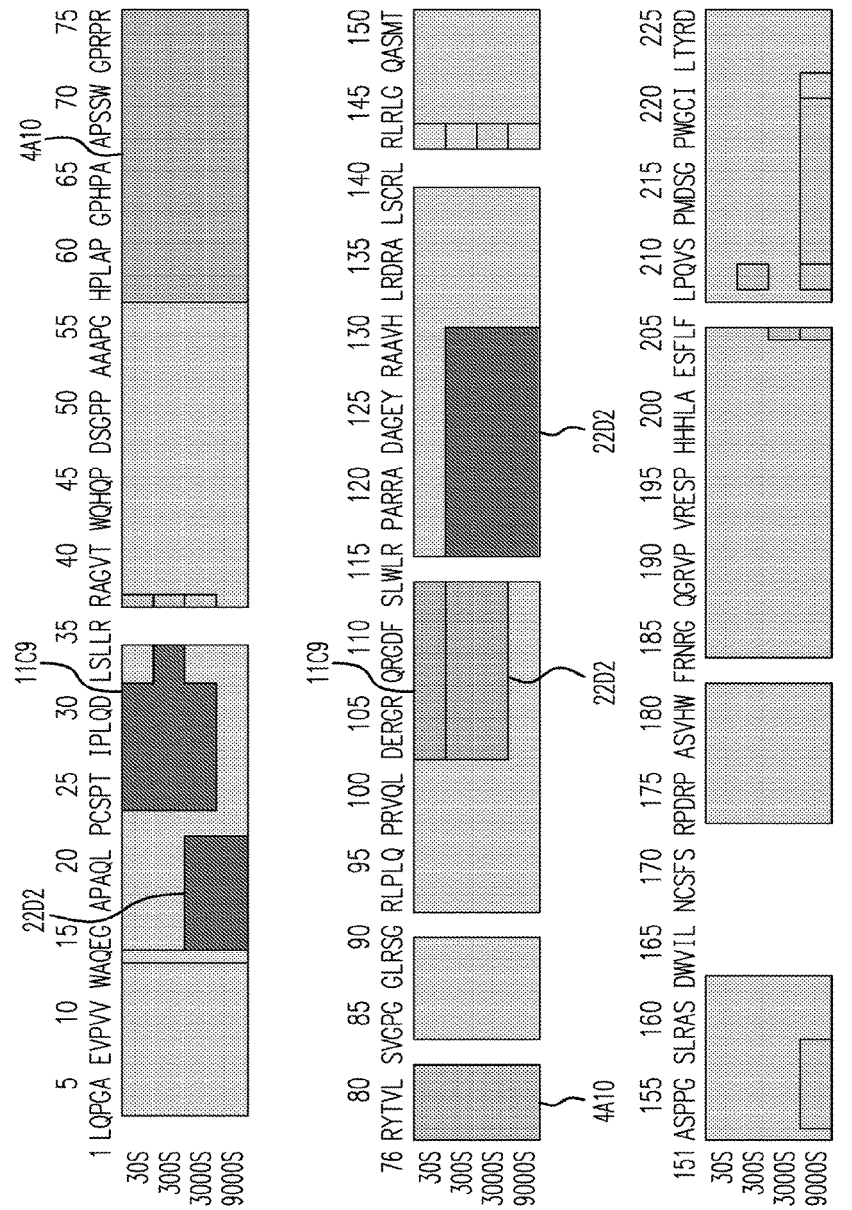
FIG. 5 (a-b). Combined heatmaps indicating (a) and (a-1) regions on human LAG3 which are protected from deuteration by 22D2, 11C9 and 4A10 binding and (b) the location in human LAG3 mediating MHC2 binding.
Figure 5B:
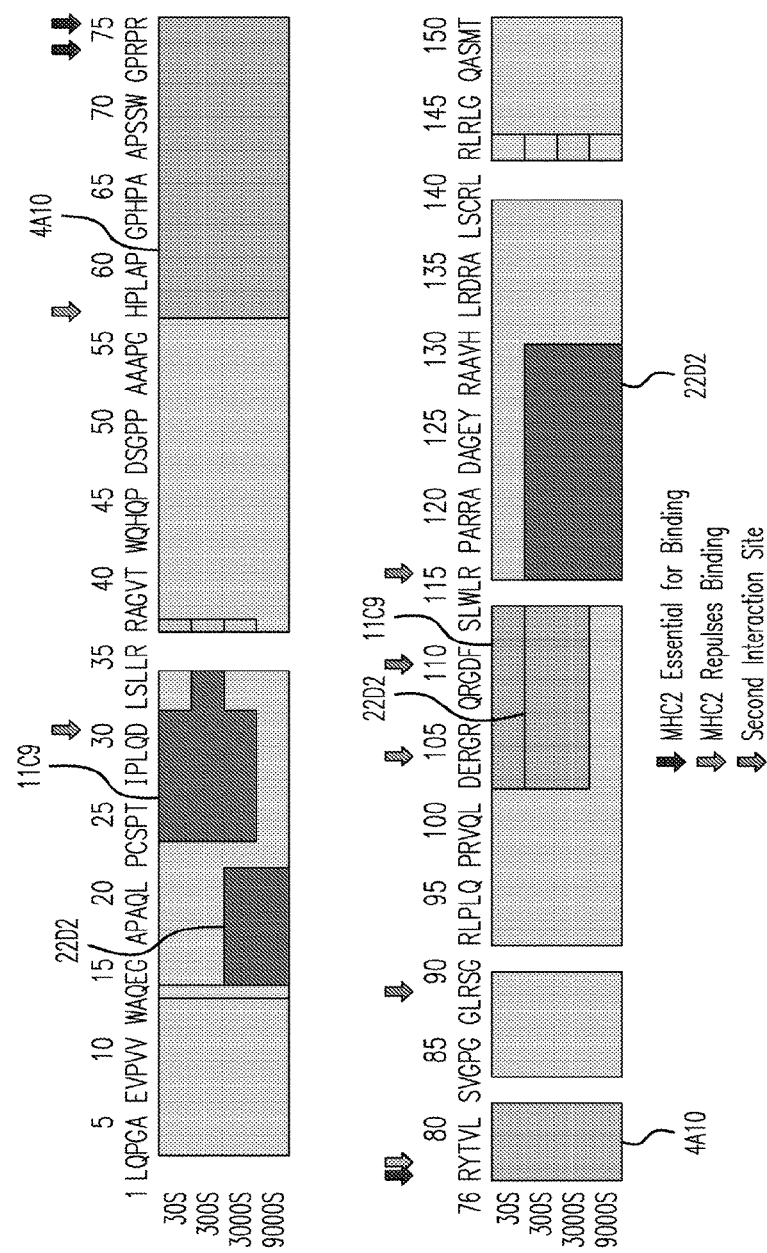

The human LAG3 residues protected by the 22D2, 4A10 and 11C9 antibodies, when bound to the LAG3 protein, are illustrated in FIGS. 3, 4(*a-c*) and 5 (a-b).

Example 9

Cell Based KinExA

The affinities of the LAG3 antibodies for LAG3 were determined using a cell based Kinetic Exclusion Assay (KinExA). Cell based KinExA can be used to measure the affinity of a molecule for a binding partner on a cell surface (Rathanaswami et al. Analytical Biochemistry 373(1): 52-60 (2008); Xie et al. J. Immunol. Methods 304 (1-2): 1-14 (2005)). In this case, BaF/3 cells were stably transfected with human and cynomolgus monkey LAG3 proteins. Transfected cells or the parental BaF/3 control cell line were grown to a density of $1.7 \times 10^6$ to $3.2 \times 10^6$ cells per ml at 37° C., 120 RPM, 5% $CO_2$, in 1×RPMI 1640 media with 10% FBS, 10 ng/ml IL-3, 5 µg/ml puromycin. Cells were concentrated, mixed with 15 pM or 150 pM antibody in cell culture media and incubated 24 to 48 hours at room temperature while rotating at 20 to 30 RPM. Cells were present at a top concentration of $2 \times 10^7$ cells per ml (parental BaF/3 or cynomolgus LAG3 transfectants) or $1 \times 10^7$ cells per ml (human LAG3 transfectants) and diluted in a 2-fold, 18 member series. The cells were pelleted and free antibody in the supernatant was measured using a KinExA 3200 instrument (Sapidyne, Idaho, USA). The instrument bound the free antibody to polymethyl methacrylate beads (Sapidyne) that had been coated with goat F(ab')$_2$ anti-human Fcγ (Jackson ImmunoResearch Laboratories, Pennsylvania, USA). Antibody on the beads was labeled with 1.5 µg/ml Alexa Fluor® 647 conjugated goat anti-human (Fab')$_2$ (Jackson ImmunoResearch Laboratories), washed and the fluorescent signal was read all using the KinExA™ 3200. The data from the 15 pM and 150 pM concentrations of each antibody were fit simultaneously using KinExA™ Pro n-Curve Analysis software version 4.0.11 (Sapidyne).

TABLE 12

KinExA affinity measurements.

|  | human LAG3 $K_D$ | | cynomolgus LAG3 $K_D$ | |
|---|---|---|---|---|
|  | $K_D$ (pM) | n | $K_D$ (pM) | n |
| 22D2 Chimera | 3 | 2 | 11 | 2 |
| Hu22D2 VH6/VL3 (Ab 5) | 6 | 2 | 25 | 2 |
| Hu22D2 VH6/VL3 N55S (Ab 7) | 10 | 2 | 11 | 2 |
| Hu22D2 VH6/VL3 N55Q (Ab 8) | 11 | 2 | 16 | 2 |
| Hu22D2 VH6/VL3 N55D (Ab 6) | 2 | 3 | 12 | 3 |

Example 10

Effect of Anti-LAG3 Antibodies on Murine T-cell Hybridoma 3A9 Cells Expressing Human LAG3

The ability of anti-LAG3 antibodies to enhance antigen-specific T cell activation was tested in a modified version of a previously described T cell activation assay (Workman et al., Eur. J. Immunol. 32:2255-2263 (2002)).

A HEL peptide$_{48-63}$-specific mouse T cell hybridoma (3A9) was stimulated with a haplotype-matched, MHCII$^+$, HEL peptide$_{48-63}$-pulsed B cell line (LK35.2) and IL-2 release was assessed as a readout for antigen-specific T cell activation. The 3A9 T cell response to HEL peptide$_{48-63}$-pulsed LK35.2 cells was dose-dependent.

3A9 T cell lines stably overexpressing mouse or human LAG3 were generated by retroviral transduction. It was demonstrated that mouse MHC2 on LK35.2 cells can engage both human and mouse LAG3, resulting in a strong reduction of the antigen-specific IL-2 production, at suboptimal T cell activation concentrations. The maximal effect of LAG3 activity was observed when titrating HEL peptide$_{48-63}$ at a concentration of 31.2 nM. The inhibitory effect of LAG3 overexpression was not seen when using LK35.2 B cells pulsed with higher peptide doses (corresponding to >100 nM). Treating with 10 ug/ml of a commercially available mouse LAG3 antibody, C9B7W, IL-2 levels were rescued to that of the vector 3A9 cells.

To assess the effect of anti-LAG3 antibodies in this assay, mouse or human LAG3-overexpressing 3A9 T cells (100,000 per well) were pretreated with anti-LAG3 antibodies (serially diluted in 3-fold dilutions from 10 ug/ml) for 30 minutes at 37° C., and stimulated with LK35.2 cells (33,333 per well) pulsed for 30 minutes prior to co-culture with 31.2 nM HEL peptide$_{48-63}$. After stimulation for 24 h at 37° C. and 5.0% $CO_2$, IL-2 secretion was assessed in culture supernatants by mesoscale. Inhibition of LAG3 with an antagonist antibody restored T-cell function resulting in the rescue of IL-2 production in a dose-dependent manner. IL-2 production was not rescued when 3A9 cell were pre-treated with isotype control antibodies. The ability of LAG3 overexpression to suppress IL-2 secretion coupled with IL-2 rescue after treatment with anti-LAG3 antibody validated this assay as a robust screening tool. Table 13 lists the EC$_{50}$s for IL-2 rescue using the hLAG3-3A9 system for the mouse anti-human and humanized anti-LAG3 antibodies.

TABLE 13

Mouse anti-human LAG3 antibodies stimulate IL-2 production in the hLAG3-3A9 T cell system

| Antibody | Range EC50, nM (n) |
|---|---|
| LB145.22D2.E1.1D1 | 1.06-1.65 (2) |
| LB148.19E8.G1.1A1 | 1.74-1.83 (2) |
| LB148.11C9.1C1 | 3.56-4.06 (2) |
| LB148.4A10.1H1 | 2.83-2.96 (2) |
| 22D2 chimera | 0.69-1.91 (5) |
| Hu22D2 VH6/VL3 (Ab 5) | 0.57-1.07 (6) |
| Hu22D2 VH6/VL3 N55S (Ab 7) | 0.45-1.27 (6) |
| Hu22D2 VH6/VL3 N55D (Ab 6) | 0.47-1.01 (6) |
| Hu22D2 VH6/VL3 N55Q (Ab 8) | 0.72-1.08 (6) |

TABLE 14

Mouse anti-human LAG3 antibodies block the interaction of human MHC Class II with human LAG3-Fc recombinant protein.

| Antibody | IC50 (nM) |
|---|---|
| LB145.22D2.E1.1D1 | 2.1 |
| LB148.19E8.G1.1A1 | 2.8 |
| LB148.11C9.1C1 | 2.0 |
| LB148.4A10.1H1 | 1.9 |
| Chimeric 22D2 | 2.5 |
| Hu22D2 VH6/VL3 (Ab 5) | 2.6 |
| Hu22D2 VH6/VL3 N55S (Ab 7) | 2.1 |
| Hu22D2 VH6/VL3 N55D (Ab 6) | 2.4 |
| Hu22D2 VH6/VL3 N55Q (Ab 8) | 2.5 |

Example 11

Blocking of LAG3/lMHC Class II Binding on Daudi Cells

Mouse anti-human LAG3 and humanized anti-LAG3 clones were tested for their ability to block hLAG3 interaction with human MHC Class II. Daudi cells (ATCC #CCL-213) were used as a cell line positive for human MHC class II expression. Daudi cells were blocked with 10 ug/ml of goat IgG in HBSS and 2% BCS on ice for 30 minutes and $0.5 \times 10^6$ cells/sample were aliquoted into a 96-well V-bottom plate and blocking buffer removed. Clones LB145.22D2.E1.1D1, LB148.19E8.G1.1A1, LB148.4A10.1H1, and LB148.11C9.1C1 and hu22D2 VH6/VL3, hu22D2 VH6/VL3 N55Q, hu22D2 VH6/VL3 N55S, hu22D2 VH6/VL3 N55D, and chimeric 22D2 were serially diluted starting at 20 ug/ml in HBSS/2% BCS and pre-incubated with 2 ug/ml of human LAG3-huFc or biotinylated human LAG3-huFc in 96-well polypropylene U-bottom plates in a final volume of 100 ul and incubated on ice for 30 minutes. Following pre-incubation, the human LAG3-Fc/antibody antibody mixtures were added to the blocked Daudi cells and incubated for 45 minutes on ice. Cells were pelleted by centrifugation at 1200 rpm and washed twice with HBSS/2% BCS. Human LAG3-Fc binding to Daudi cells was detected using F(ab)'$_2$ goat anti-human IgG-PE conjugate (Southern Biotech Cat#) at 1:200 for unconjugated huLAG3-huFc or 1:500 dilution of streptavidin-PE for biotinylated huLAG3-huFc in 100 ul staining volume and incubated on ice for 20 minutes. Cells were washed twice as described above, resuspended in HBSS/2% BCS and read on the FACSCalibur. Table 14 summarizes the IC50s for MHC class II blockade for the mouse anti-human LAG3 clones.

Humanized anti-human LAG3 antibodies (VH6/VL3, VH6/VL3 N55D, VH6/VL3 N55Q, VH6/VL3 N55S, and chimeric 22D2) were tested for their ability to block hLAG3 interaction with human MHC class II as described above. Biotinylated human LAG3-huFc was used and detection was using streptavidin-PE.

Example 12

Binding of Lag3 Clones to T Cells Isolated from Human and Cynomolgous Monkey Blood.

Binding of LAG-3 mAb clones to primary T-cells was assessed using human and cynomolgous monkey (cyno) peripheral blood mononuclear cells (PBMC). Human blood was obtained from the local donors; cyno blood was obtained from Bioreclamation. PBMC were isolated from the whole blood using Ficoll-Paque Plus (GE Healthcare, Cat#17-1440-03) density gradient centrifugation at 524×g for 40 minutes. PBMC were collected from the medium: plasma interface and washed 2 times with phosphate buffered saline (PBS). The residual red blood cells were lysed using ammonium-chloride-potassium red blood cell lysing solution (ACK, GIBCO, cat# A10492-010). Cynomolgus monkey or human PBMC ($3 \times 10^6$/ml) were stimulated with 4 µg/ml PHA (Sigma, L2769) for 48 h and 20 h, respectively. For flow cytometric analysis, $1 \times 10^6$ PHA-activated PBMCs were used per staining in 50 µl FACS staining buffer (BD, cat#554657). LAG-3 mAb clones or correspondent isotype controls were incubated with human or cyno PBMS followed by detection using goat anti-mouse IgG-PE (BD 550589). Mouse anti-human CD3-pacific blue (BD 558124, clone SP34-2), mouse anti-human CD4-PerCP (BD 550631, clone L200), and mouse anti-human CD8-APC-Cy7 (BD 557834, clone SK1) were used as phenotypic markers. Sample acquisition was performed on an LSR II flow cytometer and the data were analyzed using FlowJo software version 10.0.6 (Tree Star, Inc.).

Flow cytometry analysis revealed binding of all the analyzed anti-LAG3 antibodies to primary human and cyno T cells. $EC_{50}$ for binding to human and cynomolgus $CD4^+$ and $CD8^+$ T cells were determined for humanized 22D2 antibodies and are summarized in Table 15. The data represent 3 human and 3 cynomolgus donors after stimulation with 4 ug/ml of PHA for 40 hours prior to staining.

TABLE 15

EC$_{50}$ for binding to human and cynomolgus CD4$^+$ and CD8$^+$ T cells.

| | (EC50, pM) | | | |
|---|---|---|---|---|
| | Human LAG-3 | | Cynomolgus LAG-3 | |
| | CD4$^+$ | CD8$^+$ | CD4$^+$ | CD8$^+$ |
| Hu22D2 VH6/VL3 N55S (Ab 7) | 57 | 49 | 35 | 41 |
| Hu22D2 VH6/VL3 N55D (Ab 6) | 39 | 33 | 30 | 30 |
| Hu22D2 VH6/VL3 N55Q (Ab 8) | 41 | 35 | 27 | 31 |

Example 13

Figure 7:
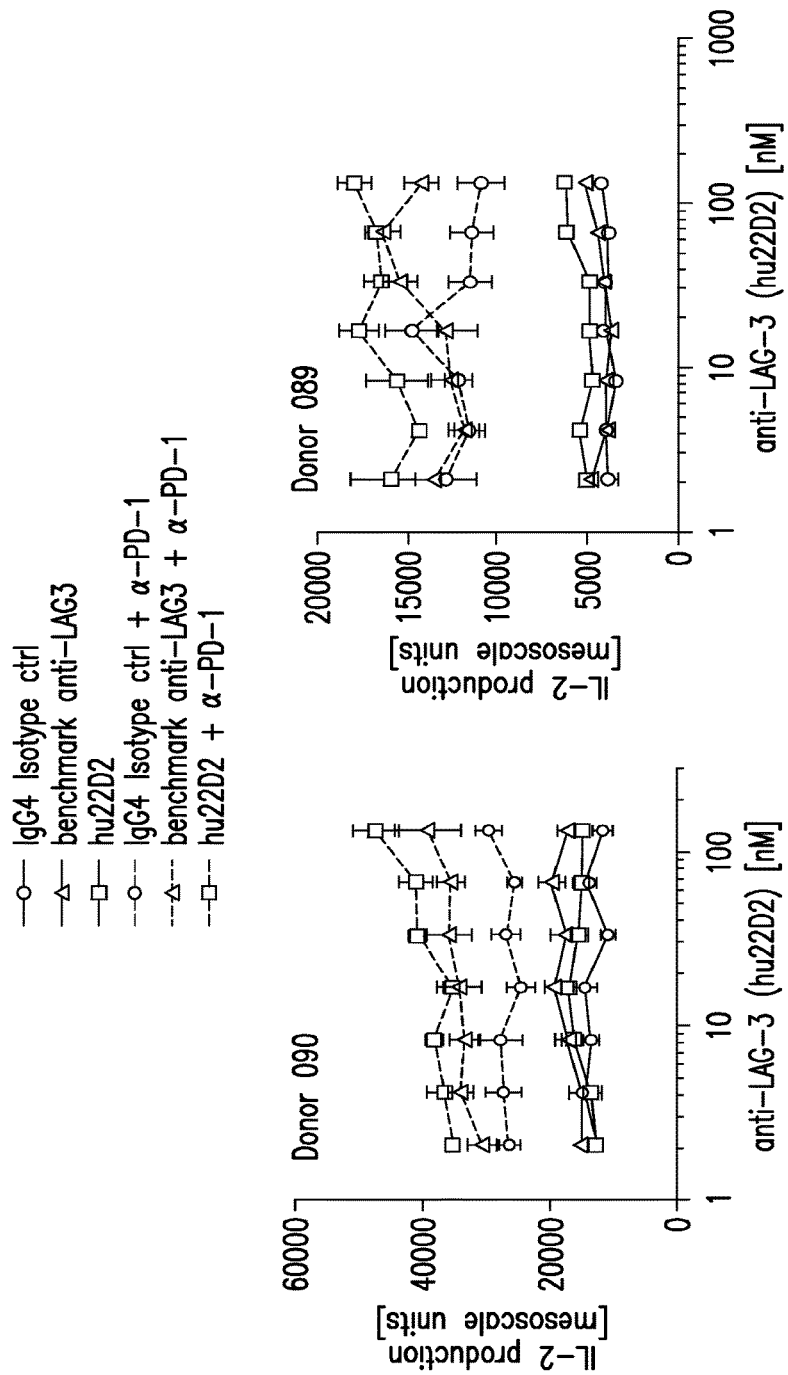
FIG. 7. Effect of anti-human LAG-3 antibody treatment+/−anti-PD-1 treatment on IL-2 production in SEB stimulated human PBMCs. PBMC were activated by SEB for 3 days and IL-2 concentration in culture supernatants was determined by MSD. Donor 090: SEB 60 ng/mL, Donor 089: SEB 30 ng/mL. Anti-PD1 was used at 10 µg/mL.

Effect of Anti-Human LAG-3 Antibody Treatment+/−Anti-PD-1 Treatment on IL-2 Production in SEB Stimulated Human PBMCs Human primary T cell assays—The first assay tested the function of blocking LAG3 alone or in combination with anti-PD-1 to increase IL-2 production by T cells following SEB activation of human PBMCs (FIG. 7). Neutralization of LAG3 activity, alone and in the presence of anti-PD-1, resulted in enhanced IL-2 production. Examples of the IL-2 mesoscale counts from 2 donors across a dose titration of anti-LAG3 antibody are shown. Hu22D2-enhanced IL-2 production by SEB-stimulated PBMC by 1.54-fold (range 1.15-2.36-fold, n=8) compared to isotype control and in combination with anti-PD1 by 1.45 fold (range 1.15-2.36-fold, n=4 at 10 or 0.3 m/ml of anti-PD-1) as compared to anti-PD-1 alone plus isotype control. Hu22D2 alone or in combination with anti-PD-1, showed comparable activity to a benchmark anti-LAG3 antibody. Hu2D2 is Ab6. α-PD-1 is a fully human IgG4 anti-human PD1 monoclonal antibody. Benchmark anti-LAG3 is a fully human IgG4 anti-human LAG3 monoclonal antibody that binds to the human LAG3 extraloop.

Example 14

Figure 8:
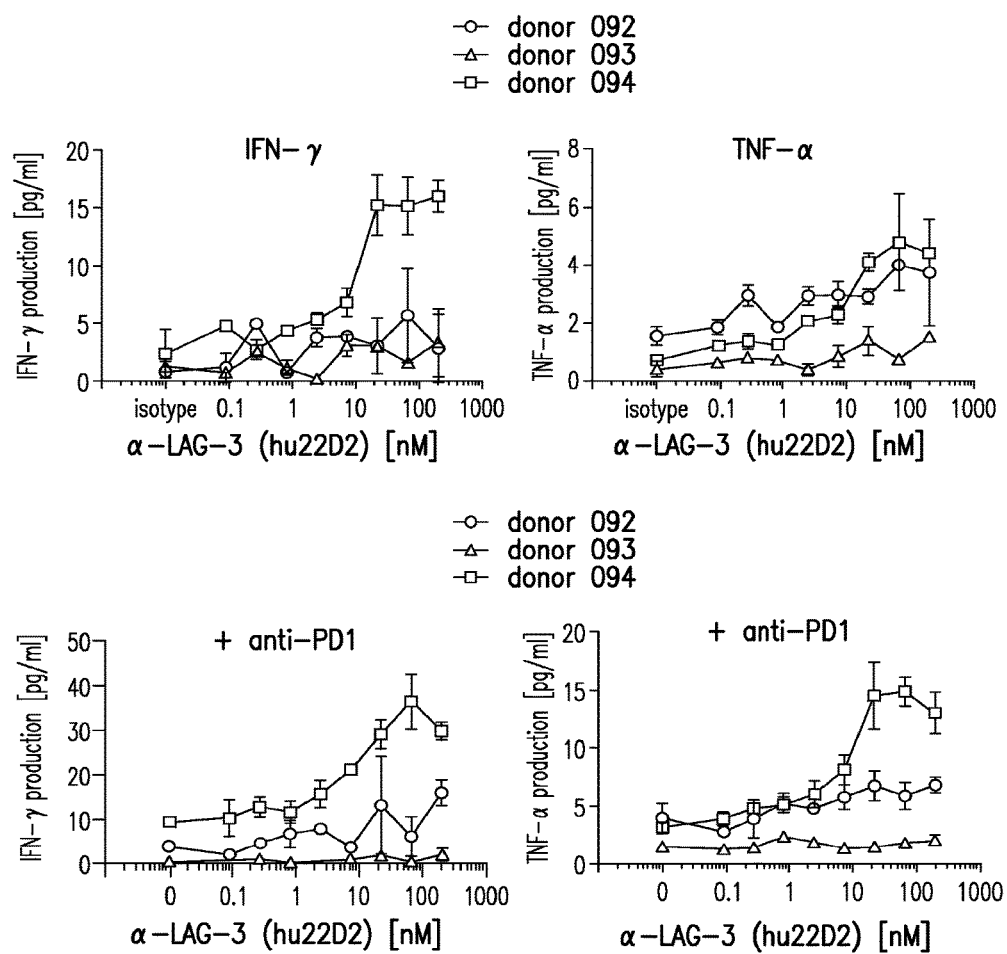
FIG. 8. Effect of hu22D2 treatment+/−anti-PD-1 treatment on IFN-γ and TNFα production in MLR stimulated human PBMCs. PBMC were activated with allogeneic monocyte-derived DC for 7 days and IFN-γ and TNF-α concentration in culture supernatants was determined by MSD. Anti-PD-1 was used at 3 µg/mL. Isotype was used at 200 nM.

Effect of hu22D2 Treatment+/−Anti-PD-1 Treatment on IFN-Gamma and TNFα Production in MLR Stimulated Human PBMCs A MLR system was also used to test the activity of hu22D2 in primary T cells. Human PBMCs are stimulated with monocyte-derived dendritic cells from a different donor, leading to T cell activation due to MHC mismatch. A high degree of variability in donor responses was observed in this assay. However, preliminary data demonstrated that neutralization of LAG3 activity, alone and in the presence of anti-PD-1 enhanced T cell activation in two out of three donors, as assessed by IFN-γ and TNF-α production (FIG. 8). Hu2D2 is Ab6.

Example 15

Pharmacokinetic and Pharmacodynamics Analysis of Anti-LAG3 in Cynomolgus Monkeys Pharmacokinetic and pharmacodynamics profile of Ab6 in cynomolgus monkeys was evaluated. Procedures involving the care and use of animals in the study were reviewed and approved. During the study, the care and use of animals were conducted in accordance with the principles outlined in the guidance of the Association for Assessment and Accreditation of Laboratory Animal Care (AAALAC), the Animal Welfare Act, the American Veterinary Medical Association (AVMA) Euthanasia Panel on Euthanasia, and the Institute for Laboratory Animal Research (ILAR) Guide to the Care and Use of Laboratory Animals.

25 naïve male cynomolgus monkeys of Chinese origin (4.0-7.0 kg at time of dosing) were used. Animals were observed twice daily. Additionally, animals were observed at each blood collection time point. Body weights were recorded once prior to each dosing occasion.

In the study, five males were assigned into each of 5 groups. Animals in all groups were administered 5 doses of test or control articles IV via a cephalic vein over 10 minutes. The doses for the groups were 0.03 mg/kg, 0.3 mg/kg, 1 mg/kg, 10 mg/kg and 30 mg/kg. Pharmacokinetic samples were drawn for all animals on Day 1: predose and 15 minutes and 1, 4, 8, 24 (Day 2), 48 (Day 3) and 96 (Day 5) hours post dose. Samples were also collected on Day 8: predose and 1, 8, 24 (Day 9), 48, (Day 10), 120 (Day 13) and 168 (Day 15) hours post dose. All samples were processed to plasma, stored frozen at −70° C.±10° C. until analyzed. Pharmacodynamic samples were drawn for all animals on Day 1: predose and 15 minutes and 1, 4, 8, 24 (Day 2), 48 (Day 3) and 96 (Day 5) hours post dose. Samples were also collected on Day 8: predose and 1, 8, 24 (Day 9), 48 (Day 10), 120 (Day 13) and 168 (Day 15) hours post dose. All samples were processed to plasma, stored frozen at −70° C.±10° C. until analyzed.

Figure 9:
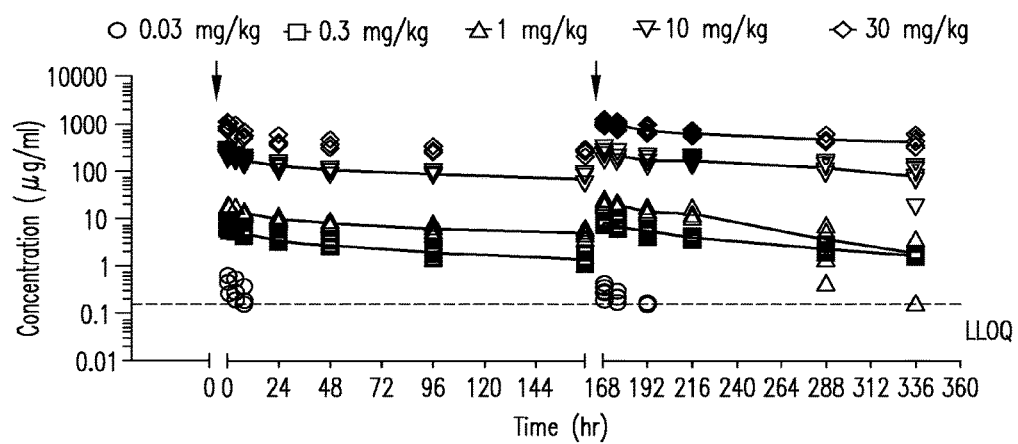
FIG. 9. Antigen-capture assay analysis of concentration of unbound and partially bound anti-LAG3 antibody Ab6 in cynomolgous monkey subjects over time at various doses (0.03 mg/kg; 0.3 mg/kg; 1 mg/kg; 10 mg/kg; 30 mg/kg).
Figure 10:
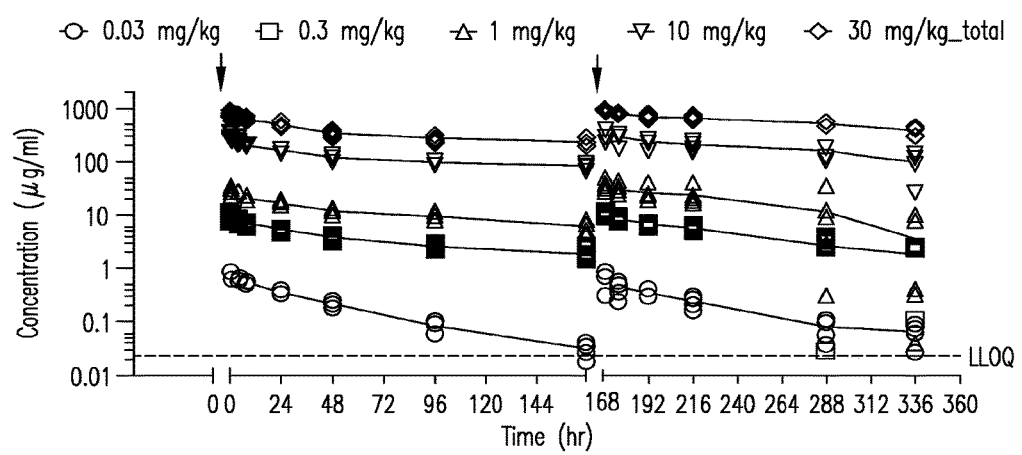
FIG. 10. Universal assay analysis of concentration of total anti-LAG3 antibody Ab6 in cynomolgous monkey subjects over time at various doses (0.03 mg/kg; 0.3 mg/kg; 1 mg/kg; 10 mg/kg; 30 mg/kg).

Total antibody and free (unbound antibody and partially bound) were evaluated by two different assays, universal assay and antigen capture assay, respectively. The data from this evaluations were set forth in FIG. 9 (Ag-Capture assay results) and FIG. 10 (Universal Assay results). The clearance and volume of distribution at steady state for each dose level were estimated and tabulated in Tables 16 (antigen capture assay) and 17 (universal assay). The differences between the antibody clearance and volume of distribution parameters demonstrated that a portion of the Ab6 antibody was engaging its target in the cynomolgous monkey subjects.

TABLE 16

LAG3 antigen-capture assay-Clearance of Ab6 and volume of distribution at steady state (Vss) at various doses.

| Dose (mg/kg) | Clearance (mL/hr/kg) | Vss (mL/kg) |
|---|---|---|
| 0.03 | 6.8 | 76.4 |
| 0.3 | 0.48 | 75.5 |
| 1 | 0.45 | 95.3 |
| 10 | 0.33 | 72.3 |
| 30 | 0.29 | 63.6 |

The antigen-capture data detected free antibody in the sample. These antigen-capture data (data not shown) demonstrated a 23-fold difference in clearance over the dose range investigated (0.003 mg/kg-30 mg/kg) (Table 16).

TABLE 17

Total antibody assay-Clearance of Ab6 and volume of distribution at steady state (Vss) at various doses.

| Dose (mg/kg) | Clearance (mL/hr/kg) | Vss (mL/kg) |
|---|---|---|
| 0.03 | 0.94 | 47 |
| 0.3 | 0.36 | 48.9 |
| 1 | 0.33 | 56.1 |
| 10 | 0.26 | 60.9 |
| 30 | 0.26 | 66.5 |

The total antibody data detected total antibody in the sample. These total antibody data (FIG. 9) demonstrated a 3.6-fold difference in clearance over the dose range investigated (0.003 mg/kg-30 mg/kg) (Table 17).

Figure 11:
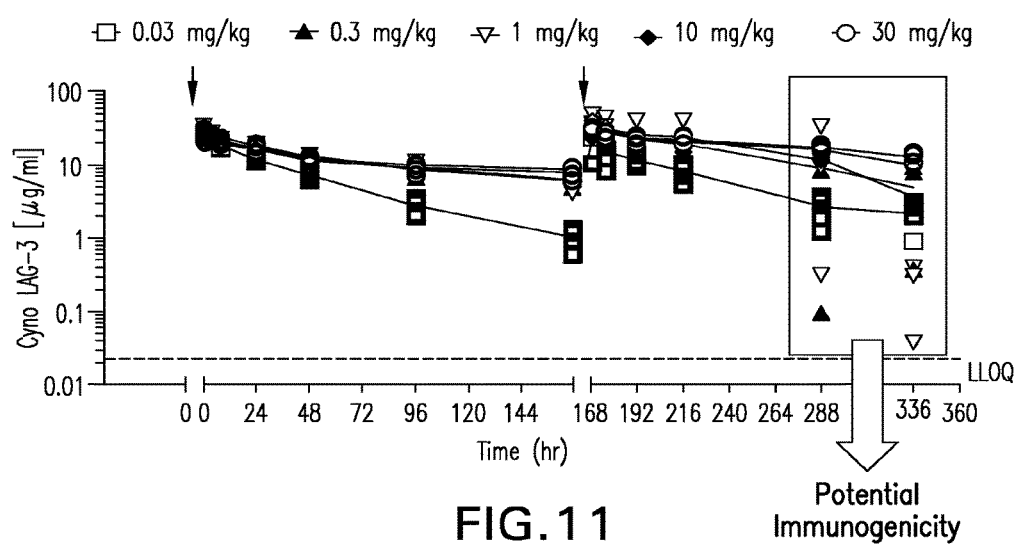
FIG. 11. The dose-normalized concentration data of Ab6 over time in cynomolgous monkey subjects at various doses (0.03 mg/kg; 0.3 mg/kg; 1 mg/kg; 10 mg/kg; 30 mg/kg).

The total concentration of Ab6 in cynolmolgous monkeys at the 0.03 mg/kg, 0.3 mg/kg, 1 mg/kg, 10 mg/kg and 30 mg/kg doses over time were evaluated. The data from this evaluation are set forth in FIG. 10. As the dose increased, the clearance of the antibody from the subjects decreased. The dose-normalized concentration data of Ab6 over time is set forth in FIG. 11. At later timepoints, after the second IV bolus administration of Ab6, there was loss of exposure indicating potential immunogenicity against the antibody.

Figure 12:
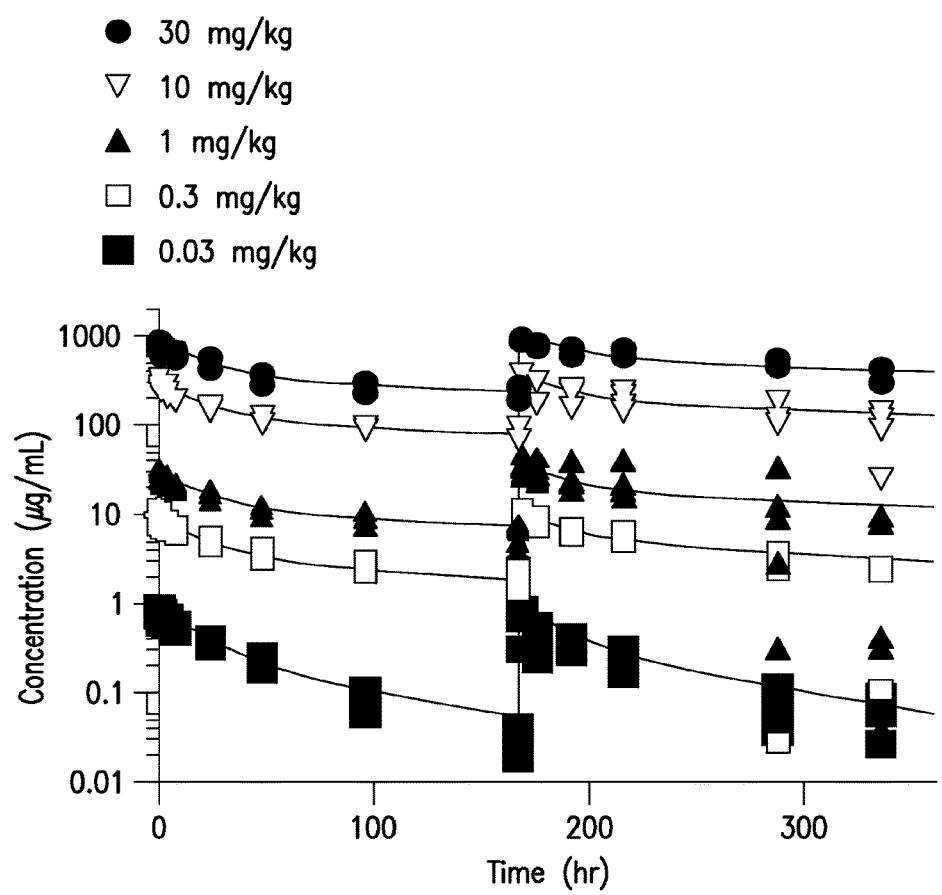
FIG. 12. Target related clearance (Vmax, Km) evaluation of various does of anti-LAG3 antibody Ab6 at various doses.

LAG3 target-mediated clearance of the Ab6 antibody was observed when concentration of the antibody were observed in the monkey subjects over time. A two compartment PK model with linear and non-linear (Vmax, Km) clearance parameters was developed to describe the concentration-time profiles for Ab6. These data are set forth in FIG. 12.

All references cited herein are incorporated by reference to the same extent as if each individual publication, database entry (e.g. Genbank sequences or GeneID entries), patent application, or patent, was specifically and individually indicated to be incorporated by reference. This statement of incorporation by reference is intended by Applicants, pursuant to 37 C.F.R. § 1.57(b)(1), to relate to each and every individual publication, database entry (e.g. Genbank sequences or GeneID entries), patent application, or patent, each of which is clearly identified in compliance with 37 C.F.R. § 1.57(b)(2), even if such citation is not immediately adjacent to a dedicated statement of incorporation by reference. The inclusion of dedicated statements of incorporation by reference, if any, within the specification does not in any way weaken this general statement of incorporation by reference. Citation of the references herein is not intended as an admission that the reference is pertinent prior art, nor does it constitute any admission as to the contents or date of these publications or documents.

The present invention is not to be limited in scope by the specific embodiments described herein. Indeed, various modifications of the invention in addition to those described herein will become apparent to those skilled in the art from the foregoing description and the accompanying figures. Such modifications are intended to fall within the scope of the appended claims.

The foregoing written specification is considered to be sufficient to enable one skilled in the art to practice the invention. Various modifications of the invention in addition to those shown and described herein will become apparent to those skilled in the art from the foregoing description and fall within the scope of the appended claims.

SEQUENCE LISTING (470 sequences)

SEQ ID NO: 1 - DNA, 408 bp, Artificial Sequence
  Description of Artificial Sequence: Synthetic polynucleotide
atgaaatgcagctgggtcatcttcttcctgatggcagtggttataggaatcaattcagaggttcagctgctccagtctggggcagaacttgtgaggtcaggggcctcagtcaagttgtcctgcacagcctctggcttcaacattgaagactactatatgcactggatgaaacagaggcctgaacagggcctggagtggattggatggattgatcctgtgaatggtgatactgaatatgccccgaagttccagggcaaggccactatgactgcagacacatcctccaacacagcctacctacacctcaacagcctgacatctgaggacactgccgtctattactgtaatttctatgatggttacctctttgctttctggggccaagggaccctggtcactgtctctgca

SEQ ID NO: 2 - protein, 136 aa, Artificial Sequence
  Description of Artificial Sequence: Synthetic polypeptide
MKCSWVIFFLMAVVIGINSEVQLLQSGAELVRSGASVKLSCTASGFNIEDYYMHWMKQRPEQGLEWIGWIDPVNGDTEYAPKFQGKATMTADTSSNTAYLHLNSLTSEDTAVYYCNFYDGYLFAFWGQGTLVTVSA

SEQ ID NO: 3 - protein, 10 aa, Artificial Sequence
  Description of Artificial Sequence: Synthetic peptide
GFNIEDYYMH

SEQ ID NO: 4 - protein, 17 aa, Artificial Sequence
  Description of Artificial Sequence: Synthetic peptide
WIDPVNGDTEYAPKFQG

SEQ ID NO: 5 - protein, 8 aa, Artificial Sequence
  Description of Artificial Sequence: Synthetic peptide
YDGYLFAF

SEQ ID NO: 6 - DNA, 396 bp, Artificial Sequence
  Description of Artificial Sequence: Synthetic polynucleotide
atgaggtgcctagctgagttcctggggctgcttgtgctctggatccctggagccattggggatattgtgctgactcaggctgcaccctctgtacctgtcactcctggagagtcagtgtccatctcctgcaggtctagtaagagtctcctgcatagtgatggcaacacttatctgtattggctcctgcagaggccaggccagtctcctcagctcctgatatatcggatgtccaaccttgcctcaggggtcccagacaggttcagcggcagtgggtcaggaactgttttcacactgagaatcagcagactggaggctgaggatgtgggtatttattactgtatgcaacatctagaatatcctttcacgtttggaggggggaccaagctggaaataaaa

SEQ ID NO: 7 - protein, 132 aa, Artificial Sequence
  Description of Artificial Sequence: Synthetic polypeptide
MRCLAEFLGLLVLWIPGAIGDIVLTQAAPSVPVTPGESVSISCRSSKSLLHSDGNTYLYWLLQRPGQSPQLLIYRMSNLASGVPDRFSGSGSGTVFTLRISRLEAEDVGIYYCMQHLEYPFTFGGGTKLEIK

SEQ ID NO: 8 - protein, 16 aa, Artificial Sequence
  Description of Artificial Sequence: Synthetic peptide
RSSKSLLHSDGNTYLY

SEQ ID NO: 9 - protein, 8 aa, Artificial Sequence
  Description of Artificial Sequence: Synthetic peptide
YRMSNLAS

SEQ ID NO: 10 - protein, 9 aa, Artificial Sequence
  Description of Artificial Sequence: Synthetic peptide
MQHLEYPFT

SEQ ID NO: 11 - DNA, 414 bp, Artificial Sequence
  Description of Artificial Sequence: Synthetic polynucleotide
atgggatggagctggatctttcttttcctcctgtcaggaactgcaggtgtccgttgccagatccgactgcagcagtctggacctgagctggtgaagcctggggcttcagtgaagatatcctgcaaggcttctgggtcctccttcactgactactatataaactgggtgaagcagaagcctggacagggacttgagtggattggatggatttatcctggaagcggtaattctatctacaatgagaacttcaaggccaaggccacattgactgtagacacatcctccagcacagcctacatgcatctcagcagcctgacatctgaggacactgctgtctatttctgtgcaagagaggctgattacgacgatgctttggactactggggtcaaggaacctcggtcaccgtctcctca

SEQ ID NO: 12 - protein, 138 aa, Artificial Sequence
  Description of Artificial Sequence: Synthetic polypeptide
MGWSWIFLFLLSGTAGVRCQIRLQQSGPELVKPGASVKISCKASGSSFTDYYINWVKQKPGQGLEWIGWIYPGSGNSIYNENFKAKATLTVDTSSSTAYMHLSSLTSEDTAVYFCAREADYDDALDYWGQGTSVTVSS

SEQ ID NO: 13 - protein, 10 aa, Artificial Sequence
  Description of Artificial Sequence: Synthetic peptide
GSSFTDYYIN

SEQ ID NO: 14 - protein, 17 aa, Artificial Sequence
  Description of Artificial Sequence: Synthetic peptide
WIYPGSGNSIYNENFKA

SEQ ID NO: 15 - protein, 10 aa, Artificial Sequence
  Description of Artificial Sequence: Synthetic peptide
EADYDDALDY

SEQ ID NO: 16 - DNA, 384 bp, Artificial Sequence
  Description of Artificial Sequence: Synthetic polynucleotide
atggtatccacacctcagttccttgtatttttgcttttctggattccagcctccagaggtcacatcttgctgactcagtctccagccattctgtctgtgagtccaggagaaagagtcagtttctcctgcagggccagtcagagcattggcacaagcatacactggtatcagcaaagaacaaatggttctccaaggcttctcataaagtatgcttctgagtctatctctgggatcccttccaggtttagtggcagtggatcagggacagattttactcttagcatcaacagtgtggagtcagaagatattgcagattattactgtcaacaaagtaatagctggccaacgtacacgttcggaggggggaccaagctggaaataaaa

SEQ ID NO: 17 - protein, 128 aa, Artificial Sequence
  Description of Artificial Sequence: Synthetic polypeptide
MVSTPQFLVFLLFWIPASRGHILLTQSPAILSVSPGERVSFSCRASQSIGTSIHWYQQRTNGSPRLLIKYASESISGIPSRFSGSGSGTDFTLSINSVESEDIADYYCQQSNSWPTYTFGGGTKLEIK

SEQ ID NO: 18 - protein, 11 aa, Artificial Sequence
  Description of Artificial Sequence: Synthetic peptide
RASQSIGTSIH

SEQ ID NO: 19 - protein, 7 aa, Artificial Sequence
  Description of Artificial Sequence: Synthetic peptide
YASESIS

SEQ ID NO: 20 - protein, 10 aa, Artificial Sequence
  Description of Artificial Sequence: Synthetic peptide
QQSNSWPTYT

SEQ ID NO: 21 - DNA, 426 bp, Artificial Sequence
  Description of Artificial Sequence: Synthetic polynucleotide
atgagatggagctgtatcatcctcttcttggtagcaacagctacaggtgtcaactcccaggtccaactgcagcagcctggggctgagcttgtgatgcctggggcttcagcgaagatgtcctgcaaggcttctggctacacactcactgactactggatgcactgggtgaagcagaggcctggacaaggccttgagtggatcggagcgattgatatttctgatagttattctagctacaatcaaaagttcaagggcaaggccacattgactgtagacgaatcctccagcacagcctacatgcagctcaccagcctgacatctgaggactctgcggtctattactgtgcaagatcccctttctacaatagtagaggggggaactactttgactactggggccaaggcaccactctcacagtctcctca

SEQ ID NO: 22 - protein, 142 aa, Artificial Sequence
  Description of Artificial Sequence: Synthetic polypeptide
MRWSCIILFLVATATGVNSQVQLQQPGAELVMPGASAKMSCKASGYTLTDYWMHWVKQRPGQGLEWIGAIDISDSYSSYNQKFKGKATLTVDESSSTAYMQLTSLTSEDSAVYYCARSPFYNSRGGNYFDYWGQGTTLTVSS

SEQ ID NO: 23 - protein, 10 aa, Artificial Sequence
  Description of Artificial Sequence: Synthetic peptide
GYTLTDYWMH

SEQ ID NO: 24 - protein, 17 aa, Artificial Sequence
  Description of Artificial Sequence: Synthetic peptide
AIDISDSYSSYNQKFKG

SEQ ID NO: 25 - protein, 14 aa, Artificial Sequence
  Description of Artificial Sequence: Synthetic peptide
SPFYNSRGGNYFDY

SEQ ID NO: 26 - DNA, 384 bp, Artificial Sequence
  Description of Artificial Sequence: Synthetic polynucleotide
atgatgtcctctgctcagttccttggtctcctgttgctctgttttcaaggtaccagatgtgatatccagatgacacagactacatcctccctgtctgcctctctgggagacagagtcaccatcagttgcagggcaagtcaggacattagcaattatttaaactggtatcagcagaaaccagatggaactgttaaactcctgatctactacacatcaagattacactcaggagtcccatcaaggttcagtggcagtgggtctggaacagattattctctcaccattagcaacctggagcaagaagatattgccacttacttttgccaacagggtgatacgcttcctccgtggacgttcggtggaggcaccaagctggaaatcaaa

SEQ ID NO: 27 - protein, 128 aa, Artificial Sequence
  Description of Artificial Sequence: Synthetic polypeptide
MMSSAQFLGLLLLCFQGTRCDIQMTQTTSSLSASLGDRVTISCRASQDISNYLNWYQQKPDGTVKLLIYYTSRLHSGVPSRFSGSGSGTDYSLTISNLEQEDIATYFCQQGDTLPPWTFGGGTKLEIK

SEQ ID NO: 28 - protein, 11 aa, Artificial Sequence
  Description of Artificial Sequence: Synthetic peptide
RASQDISNYLN

SEQ ID NO: 29 - protein, 7 aa, Artificial Sequence
  Description of Artificial Sequence: Synthetic peptide
YTSRLHS

SEQ ID NO: 30 - protein, 10 aa, Artificial Sequence
  Description of Artificial Sequence: Synthetic peptide
QQGDTLPPWT

SEQ ID NO: 31 - DNA, 447 bp, Artificial Sequence
  Description of Artificial Sequence: Synthetic polynucleotide
atgggatggacctggatctttctcttcttcctgtcaggaactgcaggtgtcctctctgaggtcctgctgctacagtctggacctgaactggtgaagcctgggacttcagtgaaaatcccctgcaaggcttctggatacacattcactgactacaacgtggactgggtgaagcagcgccatggaaagggccttgagtggattggagatattaatccaaacaatggtggtactatctacagtcagaaattcaagggcaaggccacattgactgttgacaagtcctccagcacagccttcatggagctccgcagcctgacatctgaggacactgcagtctatttctgtgcaaggaactataggtggtttggtgctatggaccactggggtcaaggaacctcagtcaccgtctcctcagccaaaacaacagccccatcggtctatccactg

SEQ ID NO: 32 - protein, 138 aa, Artificial Sequence
  Description of Artificial Sequence: Synthetic polypeptide
MGWTWIFLFFLSGTAGVLSEVLLLQSGPELVKPGTSVKIPCKASGYTFTDYNVDWVKQRHGKGLEWIGDINPNNGGTIYSQKFKGKATLTVDKSSSTAFMELRSLTSEDTAVYFCARNYRWFGAMDHWGQGTSVTVSS

SEQ ID NO: 33 - protein, 5 aa, Artificial Sequence
  Description of Artificial Sequence: Synthetic peptide
DYNVD

SEQ ID NO: 34 - protein, 17 aa, Artificial Sequence
  Description of Artificial Sequence: Synthetic peptide
DINPNNGGTIYSQKFKG

SEQ ID NO: 35 - protein, 10 aa, Artificial Sequence
  Description of Artificial Sequence: Synthetic peptide
NYRWFGAMDH

SEQ ID NO: 36 - DNA, 547 bp, Artificial Sequence
  Description of Artificial Sequence: Synthetic polynucleotide
atggagacagacacaatcctgctatgggtgctgctgctctgggttccaggttccactggtgacattgtgttgacccaatctccagcttctttggctgtgtctccagggcagagggccaccatttcctgcaaggccagtcaaagtcttgattatgaaggtgatagtgatatgaattggtaccaacagaaaccaggacagccacccagactcctcatctctggtgcatccaatctagagtctgggatcccagccaggttcagtggcagtgggtctgggacagacttcactgttaacatccatcctgtggaggaggaggatgctgcaacctattactgtcagcaaagtactgaggatcctcggacgttcggtggaggcaccaagctggaaatcaaacgggctgatgctgcaccaactgtatccatcttcccaccatccagtgagcagttaacatctggaggtgcctcagtcgtgtgcttcttgaacaacttctaccccaaagacatcaatgtcaagtggaagattgatggcagtgaacgacaaaatggcg

SEQ ID NO: 37 - protein, 131 aa, Artificial Sequence
  Description of Artificial Sequence: Synthetic polypeptide
METDTILLWVLLLWVPGSTGDIVLTQSPASLAVSPGQRATISCKASQSLDYEGDSDMNWYQQKPGQPPRLLISGASNLESGIPARFSGSGSGTDFTVNIHPVEEEDAATYYCQQSTEDPRTFGGGTKLEIK

SEQ ID NO: 38 - protein, 15 aa, Artificial Sequence
  Description of Artificial Sequence: Synthetic peptide
KASQSLDYEGDSDMN

SEQ ID NO: 39 - protein, 7 aa, Artificial Sequence
  Description of Artificial Sequence: Synthetic peptide
GASNLES

SEQ ID NO: 40 - protein, 9 aa, Artificial Sequence
  Description of Artificial Sequence: Synthetic peptide
QQSTEDPRT

SEQ ID NO: 41 - protein, 447 aa, Artificial Sequence
  Description of Artificial Sequence: Synthetic polypeptide
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 42 - protein, 218 aa, Artificial Sequence
  Description of Artificial Sequence: Synthetic polypeptide
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 43 - protein, 440 aa, Artificial Sequence
  Description of Artificial Sequence: Synthetic polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 44 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 45 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNNGGTIYSQKFKGKATLTVDKSSSTAFMELRSLTSEDTAVYFCARNYRSFGAMDHWGQGTSVTVSS

SEQ ID NO: 46 - DNA, 420 bp, Artificial Sequence
  Description of Artificial Sequence: Synthetic polynucleotide
atggagtggagctggagcgtgttcctgttcttcctggtgaccaccggcgtgcacagcgaggtgctgctgctgcagtccggccctgagctggtgaagcccggaaccagcgtgaagatcccttgcaaggccagcggctacaccttcaccgactacaacgtggactgggtgaagcagaggcacggcaaaggcctggagtggatcggcgacatcaaccccaacaacggcggcaccatctacagccagaagttcaagggcaaggccaccctgacagtggacaagagcagcagcaccgccttcatggagctgaggagcctgaccagcgaggacaccgccgtgtacttctgcgccaggaactacaggagctttggcgccatggaccactggggccagggaaccagcgtgaccgtgagctccgctagc

SEQ ID NO: 47 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNNGGTIYSQKFKGKATLTVDKSSSTAFMELRSLTSEDTAVYFCARNYRYFGAMDHWGQGTSVTVSS

SEQ ID NO: 48 - DNA, 420 bp, Artificial Sequence
  Description of Artificial Sequence: Synthetic polynucleotide
atggagtggagctggagcgtgttcctgttcttcctggtgaccaccggcgtgcacagcgaggtgctgctgctgcagtccggccctgagctggtgaagcccggaaccagcgtgaagatcccttgcaaggccagcggctacaccttcaccgactacaacgtggactgggtgaagcagaggcacggcaaaggcctggagtggatcggcgacatcaaccccaacaacggcggcaccatctacagccagaagttcaagggcaaggccaccctgacagtggacaagagcagcagcaccgccttcatggagctgaggagcctgaccagcgaggacaccgccgtgtacttctgcgccaggaactacaggtattttggcgccatggaccactggggccagggaaccagcgtgaccgtgagctccgctagc

SEQ ID NO: 49 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNNGGTIYSQKFKGKATLTVDKSSSTAFMELRSLTSEDTAVYFCARNYRQFGAMDHWGQGTSVTVSS

SEQ ID NO: 50 - DNA, 420 bp, Artificial Sequence
  Description of Artificial Sequence: Synthetic polynucleotide
atggagtggagctggagcgtgttcctgttcttcctggtgaccaccggcgtgcacagcgaggtgctgctgctgcagtccggccctgagctggtgaagcccggaaccagcgtgaagatcccttgcaaggccagcggctacaccttcaccgactacaacgtggactgggtgaagcagaggcacggcaaaggcctggagtggatcggcgacatcaaccccaacaacggcggcaccatctacagccagaagttcaagggcaaggccaccctgacagtggacaagagcagcagcaccgccttcatggagctgaggagcctgaccagcgaggacaccgccgtgtacttctgcgccaggaactacaggcaatttggcgccatggaccactggggccagggaaccagcgtgaccgtgagctccgctagc

SEQ ID NO: 51 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNSGGTIYSQKFKGKATLTVDKSSSTAFMELRSLTSEDTAVYFCARNYRWFGAMDHWGQGTSVTVSS

SEQ ID NO: 52 - DNA, 420 bp, Artificial Sequence
  Description of Artificial Sequence: Synthetic polynucleotide
atggagtggagctggagcgtgttcctgttcttcctggtgaccaccggcgtgcacagcgaggtgctgctgctgcagtccggccctgagctggtgaagcccggaaccagcgtgaagatcccttgcaaggccagcggctacaccttcaccgactacaacgtggactgggtgaagcagaggcacggcaaaggcctggagtggatcggcgacatcaaccccaacagcggcggcaccatctacagccagaagttcaagggcaaggccaccctgacagtggacaagagcagcagcaccgccttcatggagctgaggagcctgaccagcgaggacaccgccgtgtacttctgcgccaggaactacaggtggtttggcgccatggaccactggggccagggaaccagcgtgaccgtgagctccgctagc

SEQ ID NO: 53 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNDGGTIYSQKFKGKATLTVDKSSSTAFMELRSLTSEDTAVYFCARNYRWFGAMDHWGQGTSVTVSS

SEQ ID NO: 54 - DNA, 420 bp, Artificial Sequence
  Description of Artificial Sequence: Synthetic polynucleotide
atggagtggagctggagcgtgttcctgttcttcctggtgaccaccggcgtgcacagcgaggtgctgctgctgcagtccggccctgagctggtgaagcccggaaccagcgtgaagatcccttgcaaggccagcggctacaccttcaccgactacaacgtggactgggtgaagcagaggcacggcaaaggcctggagtggatcggcgacatcaaccccaacgatggcggcaccatctacagccagaagttcaagggcaaggccaccctgacagtggacaagagcagcagcaccgccttcatggagctgaggagcctgaccagcgaggacaccgccgtgtacttctgcgccaggaactacaggtggtttggcgccatggaccactggggccagggaaccagcgtgaccgtgagctccgctagc

SEQ ID NO: 55 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNNGGTIYSQKFKGKATLTVDKSSSTAFMELRSLTSEDTAVYFCARNYRWFGAMDHWGQGTSVTVSS

SEQ ID NO: 56 - DNA, 420 bp, Artificial Sequence
  Description of Artificial Sequence: Synthetic polynucleotide
atggagtggagctggagcgtgttcctgttcttcctggtgaccaccggcgtgcacagcgaggtgctgctgctgcagtccggccctgagctggtgaagcccggaaccagcgtgaagatcccttgcaaggccagcggctacaccttcaccgactacaacgtggactgggtgaagcagaggcacggcaaaggcctggagtggatcggcgacatcaaccccaacaacggcggcaccatctacagccagaagttcaagggcaaggccaccctgacagtggacaagagcagcagcaccgccttcatggagctgaggagcctgaccagcgaggacaccgccgtgtacttctgcgccaggaactacaggtggtttggcgccatggaccactggggccagggaaccagcgtgaccgtgagctccgctagc

SEQ ID NO: 57 - protein, 131 aa, Artificial Sequence
  Description of Artificial Sequence: Synthetic polypeptide
MSVPTQVLGLLLLWLTDARCDIVLTQSPASLAVSPGQRATISCKASQSLDYEGDSDMNWYQQKPGQPPRLLISGASNLESGIPARFSGSGSGTDFTVNIHPVEEEDAATYYCQQSTEDPRTFGGGTKLEIK

SEQ ID NO: 58 - DNA, 399 bp, Artificial Sequence
  Description of Artificial Sequence: Synthetic polynucleotide
atgagcgtgcccacacaggtgctgggcctgctgctgctgtggctgaccgacgccaggtgcgacatcgtgctgacccagagccctgctagcctggctgtgagccctggccagagagccaccatcagctgcaaggccagccagtccctggactacgagggcgacagcgacatgaactggtaccagcagaagcccggccagcctcccagactgctgatcagcggcgcctccaacctggagagcggcatccctgccaggtttagcggcagcggaagcggcaccgacttcaccgtgaacatccaccccgtggaagaggaggacgccgccacctactactgccagcagagcacagaggaccccaggaccttcggcggaggcaccaagctggagatcaagcgtacg

SEQ ID NO: 59 - protein, 128 aa, Artificial Sequence
  Description of Artificial Sequence: Synthetic polypeptide
MSVPTQVLGLLLLWLTDARCIILLTQSPAILSVSPGERVSFSCRASQSIGTSIHWYQQRTNGSPRLLIKYASESISGIPSRFSGSGSGTDFTLSINSVESEDIADYYCQQSSSYPTYTFGGGTKLEIK

SEQ ID NO: 60 - DNA, 390 bp, Artificial Sequence
  Description of Artificial Sequence: Synthetic polynucleotide
atgagcgtgcccacccaggtgctgggactgctgctgctgtggctgaccgacgccaggtgcatcatcctgctgacccagagccccgccattctgagcgtgagccctggcgagagggtgagcttcagctgcagggccagccagagcatcggcaccagcatccactggtaccagcagaggaccaacggcagccccaggctgctgatcaagtacgccagcgagagcatcagcggcatcccttccaggtttagcggcagcggcagcggcaccgatttcaccctgagcatcaacagcgtggagagcgaggacatcgccgactactactgccagcagagcagcagctaccccacctacaccttcggcggcggcaccaagctggagatcaagcgtacg

SEQ ID NO: 61 - protein, 128 aa, Artificial Sequence
  Description of Artificial Sequence: Synthetic polypeptide
MSVPTQVLGLLLLWLTDARCIILLTQSPAILSVSPGERVSFSCRASQSIGTSIHWYQQRTNGSPRLLIKYASESISGIPSRFSGSGSGTDFTLSINSVESEDIADYYCQQSRSYPTYTFGGGTKLEIK

SEQ ID NO: 62 - DNA, 390 bp, Artificial Sequence
  Description of Artificial Sequence: Synthetic polynucleotide
atgagcgtgcccacccaggtgctgggactgctgctgctgtggctgaccgacgccaggtgcatcatcctgctgacccagagccccgccattctgagcgtgagccctggcgagagggtgagcttcagctgcagggccagccagagcatcggcaccagcatccactggtaccagcagaggaccaacggcagccccaggctgctgatcaagtacgccagcgagagcatcagcggcatcccttccaggtttagcggcagcggcagcggcaccgatttcaccctgagcatcaacagcgtggagagcgaggacatcgccgactactactgccagcagagcagaagctaccccacctacaccttcggcggcggcaccaagctggagatcaagcgtacg

SEQ ID NO: 63 - protein, 132 aa, Artificial Sequence
  Description of Artificial Sequence: Synthetic polypeptide
MSVPTQVLGLLLLWLTDARCDIVLTQAAPSVPVTPGESVSISCRSSKSLLHSDGNTYLYWLLQRPGQSPQLLIYRLSNLASGVPDRFSGSGSGTVFTLRISRLEAEDVGIYYCMQHLEYPFTFGGGTKLEIK

SEQ ID NO: 64 - DNA, 402 bp, Artificial Sequence
  Description of Artificial Sequence: Synthetic polynucleotide
atgagcgtgcccacacaggtgctgggcctgctgctgctgtggctgacagacgccaggtgcgacattgtgctgacacaggccgctcccagcgtgcctgtgacacccggagagagcgtgagcatcagctgcaggtccagcaagtccctgctgcacagcgacggcaacacctacctgtactggctgctgcagagacccggacagagcccccagctgctgatctacaggctgtccaacctggccagcggagtgcccgacagatttagcggcagcggcagcggcaccgtgtttaccctgaggatcagcaggctggaggccgaggacgtgggcatctactactgcatgcagcacctggagtaccccttcaccttcggcggcggcaccaagctggaaatcaagcgtacg

SEQ ID NO: 65 - protein, 132 aa, Artificial Sequence
  Description of Artificial Sequence: Synthetic polypeptide
MSVPTQVLGLLLLWLTDARCDIVLTQAAPSVPVTPGESVSISCRSSKSLLHSDGNTYLYWLLQRPGQSPQLLIYRYSNLASGVPDRFSGSGSGTVFTLRISRLEAEDVGIYYCMQHLEYPFTFGGGTKLEIK

SEQ ID NO: 66 - DNA, 402 bp, Artificial Sequence
  Description of Artificial Sequence: Synthetic polynucleotide
atgagcgtgcccacacaggtgctgggcctgctgctgctgtggctgacagacgccaggtgcgacattgtgctgacacaggccgctcccagcgtgcctgtgacacccggagagagcgtgagcatcagctgcaggtccagcaagtccctgctgcacagcgacggcaacacctacctgtactggctgctgcagagacccggacagagcccccagctgctgatctacaggtactccaacctggccagcggagtgcccgacagatttagcggcagcggcagcggcaccgtgtttaccctgaggatcagcaggctggaggccgaggacgtgggcatctactactgcatgcagcacctggagtaccccttcaccttcggcggcggcaccaagctggaaatcaagcgtacg

SEQ ID NO: 67 - protein, 142 aa, Artificial Sequence
  Description of Artificial Sequence: Synthetic polypeptide
MEWSWVFLFFLSVTTGVHSQVQLQQPGAELVMPGASAKMSCKASGYTLTDYYMHWVKQRPGQGLEWIGAIDISDSYSSYNQKFKGKATLTVDESSSTAYMQLTSLTSEDSAVYYCARSPFYNNRGGNYFDYWGQGTTLTVSS

SEQ ID NO: 68 - DNA, 432 bp, Artificial Sequence
  Description of Artificial Sequence: Synthetic polynucleotide
atggagtggagctgggtgttcctcttcttcctgagcgtgaccaccggcgtgcacagccaggtgcagctgcagcagcccggagccgaactggtgatgcctggcgccagcgccaagatgagctgcaaggccagcggctacaccctgaccgactactacatgcactgggtgaagcagagacctggccagggcctggagtggattggcgccatcgacatctccgacagctacagcagctacaaccagaagttcaagggcaaggccaccctcaccgtggacgagagcagcagcaccgcctacatgcagctgaccagcctcaccagcgaggacagcgccgtgtactactgcgccaggtcccccttctacaacaacaggggcggcaactacttcgactactggggccagggcacaaccctgaccgtgagctccgctagc

SEQ ID NO: 69 - protein, 142 aa, Artificial Sequence
  Description of Artificial Sequence: Synthetic polypeptide
MEWSWVFLFFLSVTTGVHSQVQLQQPGAELVMPGASAKMSCKASGYTLTDYYMHWVKQRPGQGLEWIGAIDISDSYSSYNQKFKGKATLTVDESSSTAYMQLTSLTSEDSAVYYCARSPFYNYRGGNYFDYWGQGTTLTVSS

SEQ ID NO: 70 - DNA, 432 bp, Artificial Sequence
  Description of Artificial Sequence: Synthetic polynucleotide
atggagtggagctgggtgttcctcttcttcctgagcgtgaccaccggcgtgcacagccaggtgcagctgcagcagcccggagccgaactggtgatgcctggcgccagcgccaagatgagctgcaaggccagcggctacaccctgaccgactactacatgcactgggtgaagcagagacctggccagggcctggagtggattggcgccatcgacatctccgacagctacagcagctacaaccagaagttcaagggcaaggccaccctcaccgtggacgagagcagcagcaccgcctacatgcagctgaccagcctcaccagcgaggacagcgccgtgtactactgcgccaggtcccccttctacaactacaggggcggcaactacttcgactactggggccagggcacaaccctgaccgtgagctccgctagc

SEQ ID NO: 71 - protein, 138 aa, Artificial Sequence
  Description of Artificial Sequence: Synthetic polypeptide
MEWSWVFLFFLSVTTGVHSQIRLQQSGPELVKPGASVKISCKASGSSFTDYYINWVKQKPGQGLEWIGWIYPGSGNLIYNENFKAKATLTVDTSSSTAYMHLSSLTSEDTAVYFCAREADYDDALDYWGQGTSVTVSS

SEQ ID NO: 72 - DNA, 420 bp, Artificial Sequence
  Description of Artificial Sequence: Synthetic polynucleotide
atggagtggagctgggtgttcctcttcttcctgagcgtgaccaccggcgtgcacagccagatcaggctgcagcagagcggccccgaactggtgaaacctggcgccagcgtgaagatcagctgcaaggcctccggcagcagcttcaccgactactacatcaactgggtgaagcagaagcccggccagggcctggagtggattggctggatctaccccggcagcggcaacctgatctacaacgagaacttcaaggccaaggccaccctgaccgtggacaccagcagcagcaccgcctacatgcacctgagcagcctgaccagcgaggacaccgccgtgtacttctgcgccagagaggccgactatgacgacgccctggactactggggccagggaaccagcgtgaccgtgagcagcgctagc

SEQ ID NO: 73 - protein, 136 aa, Artificial Sequence
  Description of Artificial Sequence: Synthetic polypeptide
MEWSWVFLFFLSVTTGVHSEVQLLQSGAELVRSGASVKLSCTASGFNIEDYYMHWMKQRPEQGLEWIGWIDPVNLDTEYAPKFQGKATMTADTSSNTAYLHLNSLTSEDTAVYYCNFYDGYLFAFWGQGTLVTVSA

SEQ ID NO: 74 - DNA, 483 bp, Artificial Sequence
  Description of Artificial Sequence: Synthetic polynucleotide
atggagtggagctgggtgttcctcttcttcctgagcgtgaccaccggcgtgcacagcgaggtgcagctgctgcagagcggcgctgaactggtgagaagcggcgccagcgtgaagctgagctgcaccgccagcggcttcaacatcgaggactactacatgcactggatgaagcagagacccgagcagggcctggagtggatcggctggatcgaccccgtgaacctggacaccgagtacgcccccaagttccagggcaaggccaccatgaccgccgacaccagcagcaacaccgcctacctgcacctgaacagcctgaccagcgaggacaccgccgtgtactactgcaacttctacgacggctacctgttcgccttctggggccagggcacactggtgaccgtgagcgccgctagcaacttctacgacggctacctgttcgccttctggggccagggcacactggtgaccgtgagcgccgctagc

SEQ ID NO: 75 - protein, 136 aa, Artificial Sequence
  Description of Artificial Sequence: Synthetic polypeptide
MEWSWVFLFFLSVTTGVHSEVQLLQSGAELVRSGASVKLSCTASGFNIEDYYMHWMKQRPEQGLEWIGWIDPVNVDTEYAPKFQGKATMTADTSSNTAYLHLNSLTSEDTAVYYCNFYDGYLFAFWGQGTLVTVSA

SEQ ID NO: 76 - DNA, 414 bp, Artificial Sequence
  Description of Artificial Sequence: Synthetic polynucleotide
atggagtggagctgggtgttcctcttcttcctgagcgtgaccaccggcgtgcacagcgaggtgcagctgctgcagagcggcgctgaactggtgagaagcggcgccagcgtgaagctgagctgcaccgccagcggcttcaacatcgaggactactacatgcactggatgaagcagagacccgagcagggcctggagtggatcggctggatcgaccccgtgaacgtcgacaccgagtacgcccccaagttccagggcaaggccaccatgaccgccgacaccagcagcaacaccgcctacctgcacctgaacagcctgaccagcgaggacaccgccgtgtactactgcaacttctacgacggctacctgttcgccttctggggccagggcacactggtgaccgtgagcgccgctagc

SEQ ID NO: 77 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNSGGTIYSQKFKGKATLTVDKSSSTAFMELRSLTSEDTAVYFCARNYRSFGAMDHWGQGTSVTVSS

SEQ ID NO: 78 - DNA, 420 bp, Artificial Sequence
  Description of Artificial Sequence: Synthetic polynucleotide
atggagtggagctggagcgtgttcctgttcttcctggtgaccaccggcgtgcacagcgaggtgctgctgctgcagagcggccctgaactggtgaagcccggcaccagcgtgaagatcccctgcaaggccagcggctacaccttcaccgactacaatgtggactgggtgaagcagaggcacggcaagggcctggagtggatcggcgacatcaaccccaacagcggcggcaccatctactcccagaagttcaagggcaaggccaccctgaccgtggacaagagctccagcaccgccttcatggagctgaggagcctgaccagcgaggacaccgccgtgtacttctgcgccaggaactacaggagcttcggcgccatggatcactggggacagggcaccagcgtgaccgtgagcagcgctagc

SEQ ID NO: 79 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNSGGTIYSQKFKGKATLTVDKSSSTAFMELRSLTSEDTAVYFCARNYRYFGAMDHWGQGTSVTVSS

SEQ ID NO: 80 - DNA, 420 bp, Artificial Sequence
  Description of Artificial Sequence: Synthetic polynucleotide
atggagtggagctggagcgtgttcctgttcttcctggtgaccaccggcgtgcacagcgaggtgctgctgctgcagagcggccctgaactggtgaagcccggcaccagcgtgaagatcccctgcaaggccagcggctacaccttcaccgactacaatgtggactgggtgaagcagaggcacggcaagggcctggagtggatcggcgacatcaaccccaacagcggcggcaccatctactcccagaagttcaagggcaaggccaccctgaccgtggacaagagctccagcaccgccttcatggagctgaggagcctgaccagcgaggacaccgccgtgtacttctgcgccaggaactacaggtatttcggcgccatggatcactggggacagggcaccagcgtgaccgtgagcagcgctagc

SEQ ID NO: 81 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNSGGTIYSQKFKGKATLTVDKSSSTAFMELRSLTSEDTAVYFCARNYRQFGAMDHWGQGTSVTVSS

SEQ ID NO: 82 - DNA, 420 bp, Artificial Sequence
  Description of Artificial Sequence: Synthetic polynucleotide
atggagtggagctggagcgtgttcctgttcttcctggtgaccaccggcgtgcacagcgaggtgctgctgctgcagagcggccctgaactggtgaagcccggcaccagcgtgaagatcccctgcaaggccagcggctacaccttcaccgactacaatgtggactgggtgaagcagaggcacggcaagggcctggagtggatcggcgacatcaaccccaacagcggcggcaccatctactcccagaagttcaagggcaaggccaccctgaccgtggacaagagctccagcaccgccttcatggagctgaggagcctgaccagcgaggacaccgccgtgtacttctgcgccaggaactacaggcaattcggcgccatggatcactggggacagggcaccagcgtgaccgtgagcagcgctagc

SEQ ID NO: 83 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNDGGTIYSQKFKGKATLTVDKSSSTAFMELRSLTSEDTAVYFCARNYRSFGAMDHWGQGTSVTVSS

SEQ ID NO: 84 - DNA, 420 bp, Artificial Sequence
  Description of Artificial Sequence: Synthetic polynucleotide
atggagtggagctggagcgtgttcctgttcttcctggtgaccaccggcgtgcacagcgaggtgctgctgctgcagagcggccctgaactggtgaagcccggcaccagcgtgaagatcccctgcaaggccagcggctacaccttcaccgactacaatgtggactgggtgaagcagaggcacggcaagggcctggagtggatcggcgacatcaaccccaacgatggcggcaccatctactcccagaagttcaagggcaaggccaccctgaccgtggacaagagctccagcaccgccttcatggagctgaggagcctgaccagcgaggacaccgccgtgtacttctgcgccaggaactacaggagcttcggcgccatggatcactggggacagggcaccagcgtgaccgtgagcagcgctagc

SEQ ID NO: 85 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNDGGTIYSQKFKGKATLTVDKSSSTAFMELRSLTSEDTAVYFCARNYRYFGAMDHWGQGTSVTVSS

SEQ ID NO: 86 - DNA, 420 bp, Artificial Sequence
  Description of Artificial Sequence: Synthetic polynucleotide
atggagtggagctggagcgtgttcctgttcttcctggtgaccaccggcgtgcacagcgaggtgctgctgctgcagagcggccctgaactggtgaagcccggcaccagcgtgaagatcccctgcaaggccagcggctacaccttcaccgactacaatgtggactgggtgaagcagaggcacggcaagggcctggagtggatcggcgacatcaaccccaacgatggcggcaccatctactcccagaagttcaagggcaaggccaccctgaccgtggacaagagctccagcaccgccttcatggagctgaggagcctgaccagcgaggacaccgccgtgtacttctgcgccaggaactacaggtatttcggcgccatggatcactggggacagggcaccagcgtgaccgtgagcagcgctagc

SEQ ID NO: 87 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNDGGTIYSQKFKGKATLTVDKSSSTAFMELRSLTSEDTAVYFCARNYRQFGAMDHWGQGTSVTVSS

SEQ ID NO: 88 - DNA, 420 bp, Artificial Sequence
  Description of Artificial Sequence: Synthetic polynucleotide
atggagtggagctggagcgtgttcctgttcttcctggtgaccaccggcgtgcacagcgaggtgctgctgctgcagagcggccctgaactggtgaagcccggcaccagcgtgaagatcccctgcaaggccagcggctacaccttcaccgactacaatgtggactgggtgaagcagaggcacggcaagggcctggagtggatcggcgacatcaaccccaacgatggcggcaccatctactcccagaagttcaagggcaaggccaccctgaccgtggacaagagctccagcaccgccttcatggagctgaggagcctgaccagcgaggacaccgccgtgtacttctgcgccaggaactacaggcaattcggcgccatggatcactggggacagggcaccagcgtgaccgtgagcagcgctagc

SEQ ID NO: 89 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNTGGTIYSQKFKGKATLTVDKSSSTAFMELRSLTSEDTAVYFCARNYRWFGAMDHWGQGTSVTVSS

SEQ ID NO: 90 - DNA, 420 bp, Artificial Sequence
  Description of Artificial Sequence: Synthetic polynucleotide
atggagtggtcctggagcgtgttcctcttcttcctggtcaccacaggcgtgcactccgaggtgctgctgctgcaatccggacctgagctcgtgaagcctggaaccagcgtgaagatcccctgcaaggcctccggctacaccttcaccgactacaacgtcgactgggtgaaacagaggcacggaaagggactggagtggattggagacattaaccctaacaccggcggcaccatctactcccagaagttcaagggcaaggccaccctgaccgtcgacaagagcagcagcaccgcctttatggagctgagatccctgacatccgaggacaccgccgtctacttttgcgccaggaactacaggtggtttggcgccatggaccactggggacagggcacctccgtcaccgtgtcctccgctagc

SEQ ID NO: 91 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNVGGTIYSQKFKGKATLTVDKSSSTAFMELRSLTSEDTAVYFCARNYRWFGAMDHWGQGTSVTVSS

SEQ ID NO: 92 - DNA, 420 bp, Artificial Sequence
  Description of Artificial Sequence: Synthetic polynucleotide
atggagtggtcctggagcgtgttcctcttcttcctggtcaccacaggcgtgcactccgaggtgctgctgctgcaatccggacctgagctcgtgaagcctggaaccagcgtgaagatcccctgcaaggcctccggctacaccttcaccgactacaacgtcgactgggtgaaacagaggcacggaaagggactggagtggattggagacattaaccctaacgtgggcggcaccatctactcccagaagttcaagggcaaggccaccctgaccgtcgacaagagcagcagcaccgcctttatggagctgagatccctgacatccgaggacaccgccgtctacttttgcgccaggaactacaggtggtttggcgccatggaccactggggacagggcacctccgtcaccgtgtcctccgctagc

SEQ ID NO: 93 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNNGGTIYSQKFKGKATLTVDKSSSTAFMELRSLTSEDTAVYFCARNYRFFGAMDHWGQGTSVTVSS

SEQ ID NO: 94 - DNA, 420 bp, Artificial Sequence
  Description of Artificial Sequence: Synthetic polynucleotide
atggagtggtcctggagcgtgttcctcttcttcctggtcaccacaggcgtgcactccgaggtgctgctgctgcaatccggacctgagctcgtgaagcctggaaccagcgtgaagatcccctgcaaggcctccggctacaccttcaccgactacaacgtcgactgggtgaaacagaggcacggaaagggactggagtggattggagacattaaccctaacaatggcggcaccatctactcccagaagttcaagggcaaggccaccctgaccgtcgacaagagcagcagcaccgcctttatggagctgagatccctgacatccgaggacaccgccgtctacttttgcgccaggaactacaggttttttggcgccatggaccactggggacagggcacctccgtcaccgtgtcctccgctagc

SEQ ID NO: 95 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNNGGTIYSQKFKGKATLTVDKSSSTAFMELRSLTSEDTAVYFCARNYRIFGAMDHWGQGTSVTVSS

SEQ ID NO: 96 - DNA, 420 bp, Artificial Sequence
  Description of Artificial Sequence: Synthetic polynucleotide
atggagtggtcctggagcgtgttcctcttcttcctggtcaccacaggcgtgcactccgaggtgctgctgctgcaatccggacctgagctcgtgaagcctggaaccagcgtgaagatcccctgcaaggcctccggctacaccttcaccgactacaacgtcgactgggtgaaacagaggcacggaaagggactggagtggattggagacattaaccctaacaatggcggcaccatctactcccagaagttcaagggcaaggccaccctgaccgtcgacaagagcagcagcaccgcctttatggagctgagatccctgacatccgaggacaccgccgtctacttttgcgccaggaactacaggatctttggcgccatggaccactggggacagggcacctccgtcaccgtgtcctccgctagc

SEQ ID NO: 97 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNNGGTIYSQKFKGKATLTVDKSSSTAFMELRSLTSEDTAVYFCARNYRLFGAMDHWGQGTSVTVSS

SEQ ID NO: 98 - DNA, 420 bp, Artificial Sequence
  Description of Artificial Sequence: Synthetic polynucleotide
atggagtggtcctggagcgtgttcctcttcttcctggtcaccacaggcgtgcactccgaggtgctgctgctgcaatccggacctgagctcgtgaagcctggaaccagcgtgaagatcccctgcaaggcctccggctacaccttcaccgactacaacgtcgactgggtgaaacagaggcacggaaagggactggagtggattggagacattaaccctaacaatggcggcaccatctactcccagaagttcaagggcaaggccaccctgaccgtcgacaagagcagcagcaccgcctttatggagctgagatccctgacatccgaggacaccgccgtctacttttgcgccaggaactacaggctgtttggcgccatggaccactggggacagggcacctccgtcaccgtgtcctccgctagc

SEQ ID NO: 99 - protein, 138 aa, Artificial Sequence
  Description of Artificial Sequence: Synthetic polypeptide
MEWSWSVFLFFLVTTGVHSEVLLLQSGPELVKPGTSVKIPCKASGYTFTDYNVDWVKQRHGKGLEWIGDINPNNGGTIYSQKFKGKATLTVDKSSSTAFMELRSLTSEDTAVYFCARNYRVFGAMDHWGQGTSVTVSS

SEQ ID NO: 100 - DNA, 417 bp, Artificial Sequence
  Description of Artificial Sequence: Synthetic polynucleotide
atggagtggtcctggagcgtgttcctcttcttcctggtcaccacaggcgtgcactccgaggtgctgctgctgcaatccggacctgagctcgtgaagcctggaaccagcgtgaagatcccctgcaaggcctccggctacaccttcaccgactacaacgtcgactgggtgaaacagaggcacggaaagggactggagtggattggagacattaaccctaacaatggcggcaccatctactcccagaagttcaagggcaaggccaccctgaccgtcgacaagagcagcagcaccgcctttatggagctgagatccctgacatccgaggacaccgccgtctacttttgcgccaggaactacagggtgtttggcgccatggaccactggggacagggcacctccgtcaccgtgtcctccgct

SEQ ID NO: 101 - protein, 128 aa, Artificial Sequence
  Description of Artificial Sequence: Synthetic polypeptide
MSVPTQVLGLLLLWLTDARCDIQMTQTTSSLSASLGDRVTISCRASQDISNYLNWYQQKPDGTVKLLIYYTSRLHSGVPSRFSGSGSGTDYSLTISNLEQEDIATYFCQQGDTLPPWTFGGGTKLEIK

SEQ ID NO: 102 - DNA, 390 bp, Artificial Sequence
  Description of Artificial Sequence: Synthetic polynucleotide
atgagcgtgcccacccaggtgctgggactgctgctgctgtggctgaccgacgccaggtgcgacatccagatgacccagaccacaagcagcctgagcgcctccctgggcgacagagtgaccatcagctgtagggccagccaggacatcagcaactacctgaactggtaccagcagaagcccgacggcaccgtgaagctgctgatctactacaccagcaggctgcacagcggcgtgcctagcaggttcagcggaagcggcagcggcaccgactacagcctcaccatcagcaacctggagcaggaggacattgccacctacttctgccagcagggcgacacactgcctccttggaccttcggcggcggcaccaagctggagatcaagcgtacg

SEQ ID NO: 103 - protein, 142 aa, Artificial Sequence
  Description of Artificial Sequence: Synthetic polypeptide
MEWSWVFLFFLSVTTGVHSQVQLQQPGAELVMPGASAKMSCKASGYTLTDYWMHWVKQRPGQGLEWIGAIDISDSYSSYNQKFKGKATLTVDESSSTAYMQLTSLTSEDSAVYYCARSPFYNSRGGNYFDYWGQGTTLTVSS

SEQ ID NO: 104 - DNA, 432 bp, Artificial Sequence
  Description of Artificial Sequence: Synthetic polynucleotide
atggagtggagctgggtgttcctgttcttcctgtccgtgaccaccggcgtgcatagccaggtgcagctgcagcagcccggagctgagctggtgatgcctggagccagcgccaagatgtcctgcaaggccagcggctacaccctgaccgactactggatgcactgggtgaagcagaggcctggacagggcctggagtggatcggcgccatcgatatctccgacagctacagcagctacaaccagaagttcaagggcaaggccaccctgaccgtggacgagtccagcagcaccgcctacatgcagctgaccagcctgacctccgaggactccgccgtgtactactgcgccaggagccccttctacaactccaggggcggcaactacttcgactactggggccagggcacaaccctgaccgtgagcagcgctagc

SEQ ID NO: 105 - DNA, 1407 bp, Artificial Sequence
  Description of Artificial Sequence: Synthetic polynucleotide
atggaatggtcctgggtgttcctgttcttcctgtccgtgaccaccggcgtgcactcccagatgcagctggtgcagtctggccccgaagtgaagaaacctggcacctccgtgaaggtgtcctgcaaggcctccggctacaccttcaccgactacaacgtggactgggtccgacaggctagaggacagcggctggaatggatcggcgacatcaaccccaacaacggcggcaccatctacgcccagaaattccaagagagagtgaccatcaccgtcgataagtccacctccaccgcctacatggaactgtcctccctgcggagcgaggacaccgccgtgtactactgcgcccggaactaccggtggttcggcgccatggatcactggggccagggcaccaccgtgaccgtgtccagcgccagcacaaagggccccagcgtgttccctctggcccccagcagcaagagcacatctggcggaacagccgccctgggctgcctcgtgaaggactacttccccgagcccgtgaccgtgtcttggaactctggcgccctgaccagcggcgtgcacacctttccagccgtgctgcagagcagcggcctgtacagcctgtcctctgtggtcaccgtgcctagcagcagcctgggcacccagacctacatctgcaacgtgaaccacaagcccagcaacaccaaggtggacaagaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgagccccaggtgtacacactgccccctagccgggacgagctgaccaagaaccaggtgtccctgacctgtctggtcaagggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaaatga

SEQ ID NO: 106 - protein, 449 aa, Artificial Sequence
  Description of Artificial Sequence: Synthetic polypeptide
QMQLVQSGPEVKKPGTSVKVSCKASGYTFTDYNVDWVRQARGQRLEWIGDINPNNGGTIYAQKFQERVTITVDKSTSTAYMELSSLRSEDTAVYYCARNYRWFGAMDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 107 - DNA, 1407 bp, Artificial Sequence
  Description of Artificial Sequence: Synthetic polynucleotide
atggaatggtcctgggtgttcctgttcttcctgtccgtgaccaccggcgtgcactcccagatgcagctggtgcagtctggccccgaagtgaagaaacctggcacctccgtgaaggtgtcctgcaaggcctccggctacaccttcaccgactacaacgtggactgggtccgacaggctagaggacagcggctggaatggatcggcgacatcaaccccaactccggcggcaccatctacgcccagaaattccaagagagagtgaccatcaccgtcgataagtccacctccaccgcctacatggaactgtcctccctgcggagcgaggacaccgccgtgtactactgcgcccggaactaccggtggttcggcgccatggatcactggggccagggcaccaccgtgaccgtgtccagcgccagcacaaagggccccagcgtgttccctctggcccccagcagcaagagcacatctggcggaacagccgccctgggctgcctcgtgaaggactacttccccgagcccgtgaccgtgtcttggaactctggcgccctgaccagcggcgtgcacacctttccagccgtgctgcagagcagcggcctgtacagcctgtcctctgtggtcaccgtgcctagcagcagcctgggcacccagacctacatctgcaacgtgaaccacaagcccagcaacaccaaggtggacaagaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgagccccaggtgtacacactgccccctagccgggacgagctgaccaagaaccaggtgtccctgacctgtctggtcaagggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaaatga

SEQ ID NO: 108 - protein, 449 aa, Artificial Sequence
  Description of Artificial Sequence: Synthetic polypeptide
QMQLVQSGPEVKKPGTSVKVSCKASGYTFTDYNVDWVRQARGQRLEWIGDINPNSGGTIYAQKFQERVTITVDKSTSTAYMELSSLRSEDTAVYYCARNYRWFGAMDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 109 - DNA, 1407 bp, Artificial Sequence
  Description of Artificial Sequence: Synthetic polynucleotide
atggaatggtcctgggtgttcctgttcttcctgtccgtgaccaccggcgtgcactcccagatgcagctggtgcagtctggccccgaagtgaagaaacctggcacctccgtgaaggtgtcctgcaaggcctccggctacaccttcaccgactacaacgtggactgggtccgacaggctagaggacagcggctggaatggatcggcgacatcaaccccaacgacggcggcaccatctacgcccagaaattccaagagagagtgaccatcaccgtcgataagtccacctccaccgcctacatggaactgtcctccctgcggagcgaggacaccgccgtgtactactgcgcccggaactaccggtggttcggcgccatggatcactggggccagggcaccaccgtgaccgtgtccagcgccagcacaaagggccccagcgtgttccctctggcccccagcagcaagagcacatctggcggaacagccgccctgggctgcctcgtgaaggactacttccccgagcccgtgaccgtgtcttggaactctggcgccctgaccagcggcgtgcacacctttccagccgtgctgcagagcagcggcctgtacagcctgtcctctgtggtcaccgtgcctagcagcagcctgggcacccagacctacatctgcaacgtgaaccacaagcccagcaacaccaaggtggacaagaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgagccccaggtgtacacactgccccctagccgggacgagctgaccaagaaccaggtgtccctgacctgtctggtcaagggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaaatga

SEQ ID NO: 110 - protein, 449 aa, Artificial Sequence
  Description of Artificial Sequence: Synthetic polypeptide
QMQLVQSGPEVKKPGTSVKVSCKASGYTFTDYNVDWVRQARGQRLEWIGDINPNDGGTIYAQKFQERVTITVDKSTSTAYMELSSLRSEDTAVYYCARNYRWFGAMDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 111 - DNA, 1407 bp, Artificial Sequence
  Description of Artificial Sequence: Synthetic polynucleotide
atggaatggtcctgggtgttcctgttcttcctgtccgtgaccaccggcgtgcactcccagatgcagctggtgcagtctggccccgaagtgaagaaacctggcacctccgtgaaggtgtcctgcaaggcctccggctacaccttcaccgactacaacgtggactgggtccgacaggctagaggacagcggctggaatggatcggcgacatcaaccccaaccagggcggcaccatctacgcccagaaattccaagagagagtgaccatcaccgtcgataagtccacctccaccgcctacatggaactgtcctccctgcggagcgaggacaccgccgtgtactactgcgcccggaactaccggtggttcggcgccatggatcactggggccagggcaccaccgtgaccgtgtccagcgccagcacaaagggccccagcgtgttccctctggcccccagcagcaagagcacatctggcggaacagccgccctgggctgcctcgtgaaggactacttccccgagcccgtgaccgtgtcttggaactctggcgccctgaccagcggcgtgcacacctttccagccgtgctgcagagcagcggcctgtacagcctgtcctctgtggtcaccgtgcctagcagcagcctgggcacccagacctacatctgcaacgtgaaccacaagcccagcaacaccaaggtggacaagaaggtggaacccaagagctgcgacaagacccacacctgtcccccctgccctgcccctgaactgctgggcggaccctccgtgttcctgttccccccaaagcccaaggacaccctgatgatcagccggacccccgaagtgacctgcgtggtggtggacgtgtcccacgaggaccctgaagtgaagttcaattggtacgtggacggcgtggaagtgcacaacgccaagaccaagcccagagaggaacagtacaacagcacctaccgggtggtgtccgtgctgaccgtgctgcaccaggactggctgaacggcaaagagtacaagtgcaaggtgtccaacaaggccctgcctgcccccatcgagaaaaccatcagcaaggccaagggccagccccgcgagccccaggtgtacacactgccccctagccgggacgagctgaccaagaaccaggtgtccctgacctgtctggtcaagggcttctaccccagcgatatcgccgtggaatgggagagcaacggccagcccgagaacaactacaagaccaccccccctgtgctggacagcgacggctcattcttcctgtacagcaagctgaccgtggacaagagccggtggcagcagggcaacgtgttcagctgcagcgtgatgcacgaggccctgcacaaccactacacccagaagtccctgagcctgagccccggcaaatga

SEQ ID NO: 112 - protein, 449 aa, Artificial Sequence
  Description of Artificial Sequence: Synthetic polypeptide
QMQLVQSGPEVKKPGTSVKVSCKASGYTFTDYNVDWVRQARGQRLEWIGDINPNQGGTIYAQKFQERVTITVDKSTSTAYMELSSLRSEDTAVYYCARNYRWFGAMDHWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - DNA, 1398 bp, Artificial Sequence
  Description of Artificial Sequence: Synthetic polynucleotide
atggaatggtcctgggtgttcctgttcttcctgtccgtgaccaccggcgtgcactcccagatgcagctggtgcagtctggccccgaagtgaagaaacctggcacctccgtgaaggtgtcctgcaaggcctccggctacaccttcaccgactacaacgtggactgggtccgacaggctagaggacagcggctggaatggatcggcgacatcaaccccaacaacggcggcaccatctacgcccagaaattccaagagagagtgaccatcaccgtcgataagtccacctccaccgcctacatggaactgtcctccctgcggagcgaggacaccgccgtgtactactgcgcccggaactaccggtggttcggcgccatggatcactggggccagggcaccaccgtgaccgtgtcctctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 114 - protein, 446 aa, Artificial Sequence
  Description of Artificial Sequence: Synthetic polypeptide
QMQLVQSGPEVKKPGTSVKVSCKASGYTFTDYNVDWVRQARGQRLEWIGDINPNNGGTIYAQKFQERVTITVDKSTSTAYMELSSLRSEDTAVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 115 - DNA, 1398 bp, Artificial Sequence
  Description of Artificial Sequence: Synthetic polynucleotide
atggaatggtcctgggtgttcctgttcttcctgtccgtgaccaccggcgtccactcccagatgcagctggtgcagtccggccctgaagtgaagaaacccggcacctccgtgaaggtgtcctgcaaggcctccggctacaccttcaccgactacaacgtggactgggtgcgacaggccagaggccagagactggaatggatcggcgacatcaaccccaacgacggcggcaccatctacgcccagaaattccaggaacgcgtcaccatcaccgtggacaagtccacctccaccgcctacatggaactgtcctccctgagatccgaggacaccgccgtgtactactgcgcccggaattaccggtggttcggcgccatggatcattggggccagggcaccacagtgaccgtgtcctctgcttccaccaagggcccctcagtgttccctctggccccttgctccagatccacctccgagtctaccgccgctctgggctgcctggtgaaagactacttccccgagcccgtgacagtgtcctggaactctggcgctctgaccagtggcgtgcacaccttccctgccgtgctgcagtctagcggcctgtactccctgtcctccgtggtgacagtgccttcctccagcctgggcaccaagacctacacctgtaacgtggaccacaagccctccaacaccaaggtggacaagcgggtggaatctaagtacggccctccctgcccaccttgccctgcccctgaatttctgggaggcccctccgtgtttctgttccccccaaagcccaaggacaccctgatgatctcccggacccctgaagtgacctgcgtggtggtggacgtgtcccaggaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagagtacaagtgcaaagtcagcaacaagggcctgccctccagcatcgaaaagaccatctccaaggccaaggggcagccccgcgagcctcaggtgtacacactgccacctagccaggaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggataagagccggtggcaggaaggcaatgtctttagctgcagcgtgatgcacgaggccctgcacaaccactacacccagaagtccctgtccctgagcctgggcaaatga

SEQ ID NO: 116 - protein, 446 aa, Artificial Sequence
  Description of Artificial Sequence: Synthetic polypeptide
QMQLVQSGPEVKKPGTSVKVSCKASGYTFTDYNVDWVRQARGQRLEWIGDINPNDGGTIYAQKFQERVTITVDKSTSTAYMELSSLRSEDTAVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 117 - DNA, 1398 bp, Artificial Sequence
  Description of Artificial Sequence: Synthetic polynucleotide
atggaatggtcctgggtgttcctgttcttcctgtccgtgaccaccggcgtgcactcccagatgcagctggtgcagtctggccccgaagtgaagaaacctggcacctccgtgaaggtgtcctgcaaggcctccggctacaccttcaccgactacaacgtggactgggtccgacaggctagaggacagcggctggaatggatcggcgacatcaaccccaactccggcggcaccatctacgcccagaaattccaagagagagtgaccatcaccgtcgataagtccacctccaccgcctacatggaactgtcctccctgcggagcgaggacaccgccgtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 118 - protein, 446 aa, Artificial Sequence
  Description of Artificial Sequence: Synthetic polypeptide
QMQLVQSGPEVKKPGTSVKVSCKASGYTFTDYNVDWVRQARGQRLEWIGDINPNSGGTIYAQKFQERVTITVDKSTSTAYMELSSLRSEDTAVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 119 - DNA, 1398 bp, Artificial Sequence
  Description of Artificial Sequence: Synthetic polynucleotide
atggaatggtcctgggtgttcctgttcttcctgtccgtgaccaccggcgtgcactcccagatgcagctggtgcagtctggccccgaagtgaagaaacctggcacctccgtgaaggtgtcctgcaaggcctccggctacaccttcaccgactacaacgtggactgggtccgacaggctagaggacagcggctggaatggatcggcgacatcaaccccaaccagggcggcaccatctacgcccagaaattccaagagagagtgaccatcaccgtcgataagtccacctccaccgcctacatggaactgtcctccctgcggagcgaggacaccgccgtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 120 - protein, 446 aa, Artificial Sequence
  Description of Artificial Sequence: Synthetic polypeptide
QMQLVQSGPEVKKPGTSVKVSCKASGYTFTDYNVDWVRQARGQRLEWIGDINPNQGGTIYAQKFQERVTITVDKSTSTAYMELSSLRSEDTAVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 121 - DNA, 1398 bp, Artificial Sequence
  Description of Artificial Sequence: Synthetic polynucleotide
atggaatggtcctgggtgttcctgttcttcctgtccgtgaccaccggcgtgcactcccagatgcagctggtgcagtctggccccgaagtgaagaaacctggcacctccgtgaaggtgtcctgcaaggcctccggctacaccttcaccgactacaacgtggactgggtccgacaggctagaggacagcggctggaatggatcggcgacatcaaccccaacggcggcggcaccatctacgcccagaaattccaagagagagtgaccatcaccgtcgataagtccacctccaccgcctacatggaactgtcctccctgcggagcgaggacaccgccgtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 122 - protein, 446 aa, Artificial Sequence
  Description of Artificial Sequence: Synthetic polypeptide
QMQLVQSGPEVKKPGTSVKVSCKASGYTFTDYNVDWVRQARGQRLEWIGDINPNGGGTIYAQKFQERVTITVDKSTSTAYMELSSLRSEDTAVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 123 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacaacggcggcaccatctacgcccagaaattccagggcagagtgacctccaccgtggacacctccatctccaccgcctacatggaactgtcccggctgcggagcgacgacaccgtggtgtactactgcgcccggaactaccggtccttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 124 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNNGGTIYAQKFQGRVTSTVDTSISTAYMELSRLRSDDTVVYYCARNYRSFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 125 - DNA, 717 bp, Artificial Sequence
  Description of Artificial Sequence: Synthetic polynucleotide
atgtccgtgcctacccaggtgctgggactgctgctgctgtggctgaccgacgccagatgcgacatcgtcatgacccagacccctctgtccctgtccgtgacacccggccagcctgcttccatttcctgcaaggcctcccagtccctggactacgaaggcgactccgacatgaattggtatctgcagaagcctggccagcctcctcagctgctgatctacggcgcctccaatctggagtctggcgtgcccgacagattctccggatctggcagtggcaccgacttcaccctgaagatcagccgggtggaagccgaggacgtgggcgtgtactactgtcagcagtctaccgaggaccctcggacctttggcggaggcaccaaggtggaaatcaagcggacagtggctgccccttccgtgtttatcttccctccatccgacgaacagctgaagtccggcaccgcctctgtggtctgcctgctgaacaacttctacccacgcgaggccaaggtccagtggaaggtggacaacgccctgcagtccggcaactcccaggaatccgtcaccgagcaggactccaaagactccacctacagcctgtccagcaccctgaccctgagcaaggccgactacgagaagcacaaggtgtacgcctgcgaagtgacccaccagggcctgagcagccccgtgaccaagtccttcaaccggggcgagtgctga

SEQ ID NO: 126 - protein, 238 aa, Artificial Sequence
  Description of Artificial Sequence: Synthetic polypeptide
MSVPTQVLGLLLLWLTDARCDIVMTQTPLSLSVTPGQPASISCKASQSLDYEGDSDMNWYLQKPGQPPQLLIYGASNLESGVPDRFSGSGSGTDFTLKISRVEAEDVGVYYCQQSTEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 127 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacaacggcggcaccatctacgcccagaaattccagggcagagtgaccatgaccgtggacacctccacctccaccgtgtacatggaactgtcctccctgcggagcgaggacaccgccgtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 128 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNNGGTIYAQKFQGRVTMTVDTSTSTVYMELSSLRSEDTAVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 129 - DNA, 720 bp, Artificial Sequence
  Description of Artificial Sequence: Synthetic polynucleotide
atgagcgtgcccacacaggtgctgggcctgctgctgctgtggctgaccgacgccagatgcgacgtggtgatgacccagagccctctgtccctgcccgtgacactgggacagcccgctagcatcagctgcagaagcagcaagagcctgctgcacagcgacggcaacacctacctgtactggttccagcagaggcccggacagagccccaggagactgatctacaggatgagcaacctggcctccggcgtgcccgatagattctccggcagcggctccggcaccgacttcaccctgaagatctccagagtggaggccgaggacgtgggcgtgtactactgcatgcagcacctggagtaccccttcaccttcggcggcggcacaaaggtggagatcaagcgtacggtggctgccccctccgtgttcatcttcccccccagcgatgagcagctgaagagcggcacagccagcgtggtgtgcctgctgaacaacttctaccccagggaggccaaggtgcagtggaaggtggacaacgccctgcagagcggcaacagccaggagtccgtgaccgagcaggacagcaaggacagcacctacagcctgagcagcacactgaccctgagcaaggccgactacgagaagcacaaggtgtacgcctgcgaggtgacccatcagggcctgagcagccccgtgaccaagagcttcaacaggggcgagtgctga

SEQ ID NO: 130 - protein, 219 aa, Artificial Sequence
  Description of Artificial Sequence: Synthetic polypeptide
DVVMTQSPLSLPVTLGQPASISCRSSKSLLHSDGNTYLYWFQQRPGQSPRRLIYRMSNLASGVPDRFSGSGSGTDFTLKISRVEAEDVGVYYCMQHLEYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 131 - DNA, 708 bp, Artificial Sequence
  Description of Artificial Sequence: Synthetic polynucleotide
atgagcgtgcccacacaggtgctgggcctgctgctgctgtggctgaccgacgccaggtgcgagatcgtgatgacccagagccctgccacactgagcgtgagccctggcgagagagctaccctgagctgcagggcctcccagagcatcggcaccagcatccactggtaccagcagaagcctggacaggcccccaggctgctgatctactacgccagcgagagcatcagcggcatccctgccagatttagcggcagcggcagcggcaccgagttcacactgaccatcagcagcctgcagagcgaggacttcgccgtgtactactgccagcagagcaacagctggcctacctacaccttcggcggcggcaccaaggtggagatcaagcgtacggtggctgccccctccgtgttcatcttcccccccagcgatgagcagctgaagagcggcacagccagcgtggtgtgcctgctgaacaacttctaccccagggaggccaaggtgcagtggaaggtggacaacgccctgcagagcggcaacagccaggagtccgtgaccgagcaggacagcaaggacagcacctacagcctgagcagcacactgaccctgagcaaggccgactacgagaagcacaaggtgtacgcctgcgaggtgacccatcagggcctgagcagccccgtgaccaagagcttcaacaggggcgagtgctga

SEQ ID NO: 132 - protein, 215 aa, Artificial Sequence
  Description of Artificial Sequence: Synthetic polypeptide
EIVMTQSPATLSVSPGERATLSCRASQSIGTSIHWYQQKPGQAPRLLIYYASESISGIPARFSGSGSGTEFTLTISSLQSEDFAVYYCQQSNSWPTYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 133 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagcggctggaatggatgggcgacatcaaccccaactccggcggcaccatctactcccagaaattccagggcagagtgaccatcaccgtggacacctccgcctccaccgcctacatggaactgtcctccctgcggagcgaggacaccgccgtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 134 - protein, 446 aa, Artificial Sequence
  Description of Artificial Sequence: Synthetic polypeptide
QVQLVQSGAEVKKPGASVKVSCKASGYTFTDYNVDWVRQAPGQRLEWMGDINPNSGGTIYSQKFQGRVTITVDTSASTAYMELSSLRSEDTAVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 135 - DNA, 717 bp, Artificial Sequence
  Description of Artificial Sequence: Synthetic polynucleotide
atgtccgtgcccacccaggtgctgggactgctgctgctgtggctgaccgacgccagatgcgacgtggtgatgacccagtcccccctgtccctgcctgtgacactgggccagcctgcctccatctcctgcaaggcctcccagtccctggactacgagggcgactccgacatgaactggttccagcagcggcctggccagtcccctcggagactgatctacggcgcctccaacctggaatccggcgtgcccgacagattctccggctccggctctggcaccgacttcaccctgaagatcagccgggtggaagccgaggacgtgggcgtgtactactgccagcagtccaccgaggacccccggacctttggcggaggcaccaaggtggaaatcaagcggaccgtggccgctccctccgtgttcatcttcccaccctccgacgagcagctgaagtccggcaccgcctccgtggtctgcctgctgaacaacttctaccctcgcgaggccaaggtgcagtggaaggtggacaacgccctgcagtccggcaactcccaagaatccgtgaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgctga

SEQ ID NO: 136 - protein, 218 aa, Artificial Sequence
  Description of Artificial Sequence: Synthetic polypeptide
DVVMTQSPLSLPVTLGQPASISCKASQSLDYEGDSDMNWFQQRPGQSPRRLIYGASNLESGVPDRFSGSGSGTDFTLKISRVEAEDVGVYYCQQSTEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 137 - DNA, 717 bp, Artificial Sequence
  Description of Artificial Sequence: Synthetic polynucleotide
atgtccgtgcccacccaggtgctgggactgctgctgctgtggctgaccgacgccagatgcgacatcgtgatgacccagacccccctgtccctgtccgtgacacctggccagcctgcctccatctcctgcaaggcctcccagtccctggactacgagggcgactccgacatgaactggtatctgcagaagcccggccagccccctcagctgctgatctacggcgcctccaacctggaatccggcgtgcccgacagattctccggctccggctctggcaccgacttcaccctgaagatcagccgggtggaagccgaggacgtgggcgtgtactactgccagcagtccaccgaggacccccggacctttggcggaggcaccaaggtggaaatcaagcggaccgtggccgctccctccgtgttcatcttcccaccctccgacgagcagctgaagtccggcaccgcctccgtggtctgcctgctgaacaacttctaccctcgcgaggccaaggtgcagtggaaggtggacaacgccctgcagtccggcaactcccaagaatccgtgaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgctga

SEQ ID NO: 138 - protein, 218 aa, Artificial Sequence
  Description of Artificial Sequence: Synthetic polypeptide
DIVMTQTPLSLSVTPGQPASISCKASQSLDYEGDSDMNWYLQKPGQPPQLLIYGASNLESGVPDRFSGSGSGTDFTLKISRVEAEDVGVYYCQQSTEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 139 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacgacggcggcaccatctacgcccagaaattccagggcagagtgacctccaccgtggacacctccatctccaccgcctacatggaactgtcccggctgcggagcgacgacaccgtggtgtactactgcgcccggaactaccggtccttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 140 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNDGGTIYAQKFQGRVTSTVDTSISTAYMELSRLRSDDTVVYYCARNYRSFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 141 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacgacggcggcaccatctacgcccagaaattccagggcagagtgacctccaccgtggacacctccatctccaccgcctacatggaactgtcccggctgcggagcgacgacaccgtggtgtactactgcgcccggaactaccggtacttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 142 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNDGGTIYAQKFQGRVTSTVDTSISTAYMELSRLRSDDTVVYYCARNYRYFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 143 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacgacggcggcaccatctacgcccagaaattccagggcagagtgacctccaccgtggacacctccatctccaccgcctacatggaactgtcccggctgcggagcgacgacaccgtggtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 144 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNDGGTIYAQKFQGRVTSTVDTSISTAYMELSRLRSDDTVVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 145 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaactccggcggcaccatctacgcccagaaattccagggcagagtgacctccaccgtggacacctccatctccaccgcctacatggaactgtcccggctgcggagcgacgacaccgtggtgtactactgcgcccggaactaccggcagttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 146 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNSGGTIYAQKFQGRVTSTVDTSISTAYMELSRLRSDDTVVYYCARNYRQFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 147 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaactccggcggcaccatctacgcccagaaattccagggcagagtgacctccaccgtggacacctccatctccaccgcctacatggaactgtcccggctgcggagcgacgacaccgtggtgtactactgcgcccggaactaccggtccttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 148 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNSGGTIYAQKFQGRVTSTVDTSISTAYMELSRLRSDDTVVYYCARNYRSFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 149 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaactccggcggcaccatctacgcccagaaattccagggcagagtgacctccaccgtggacacctccatctccaccgcctacatggaactgtcccggctgcggagcgacgacaccgtggtgtactactgcgcccggaactaccggtacttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 150 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNSGGTIYAQKFQGRVTSTVDTSISTAYMELSRLRSDDTVVYYCARNYRYFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 151 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaactccggcggcaccatctacgcccagaaattccagggcagagtgacctccaccgtggacacctccatctccaccgcctacatggaactgtcccggctgcggagcgacgacaccgtggtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 152 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNSGGTIYAQKFQGRVTSTVDTSISTAYMELSRLRSDDTVVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 153 - DNA, 1398 bp, Artificial Sequence; identical to SEQ ID NO: 123
  Description of Artificial Sequence: Synthetic polynucleotide

SEQ ID NO: 154 - protein, 446 aa, Artificial Sequence; identical to SEQ ID NO: 124
  Description of Artificial Sequence: Synthetic polypeptide

SEQ ID NO: 155 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacaacggcggcaccatctacgcccagaaattccagggcagagtgacctccaccgtggacacctccatctccaccgcctacatggaactgtcccggctgcggagcgacgacaccgtggtgtactactgcgcccggaactaccggtacttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 156 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNNGGTIYAQKFQGRVTSTVDTSISTAYMELSRLRSDDTVVYYCARNYRYFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 157 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacaacggcggcaccatctacgcccagaaattccagggcagagtgacctccaccgtggacacctccatctccaccgcctacatggaactgtcccggctgcggagcgacgacaccgtggtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 158 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNNGGTIYAQKFQGRVTSTVDTSISTAYMELSRLRSDDTVVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 159 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacgacggcggcaccatctacgcccagaaattccagggcagagtgacctccaccgtggacacctccatctccaccgcctacatggaactgtcccggctgcggagcgacgacaccgtggtgtactactgcgcccggaactaccggcagttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 160 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNDGGTIYAQKFQGRVTSTVDTSISTAYMELSRLRSDDTVVYYCARNYRQFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 161 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacgacggcggcaccatctacgcccagaaattccagggcagagtgaccatgaccgtggacacctccacctccaccgtgtacatggaactgtcctccctgcggagcgaggacaccgccgtgtactactgcgcccggaactaccggcagttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 162 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNDGGTIYAQKFQGRVTMTVDTSTSTVYMELSSLRSEDTAVYYCARNYRQFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 163 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacgacggcggcaccatctacgcccagaaattccagggcagagtgaccatgaccgtggacacctccacctccaccgtgtacatggaactgtcctccctgcggagcgaggacaccgccgtgtactactgcgcccggaactaccggtccttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 164 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNDGGTIYAQKFQGRVTMTVDTSTSTVYMELSSLRSEDTAVYYCARNYRSFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 165 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacgacggcggcaccatctacgcccagaaattccagggcagagtgaccatgaccgtggacacctccacctccaccgtgtacatggaactgtcctccctgcggagcgaggacaccgccgtgtactactgcgcccggaactaccggtacttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 166 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNDGGTIYAQKFQGRVTMTVDTSTSTVYMELSSLRSEDTAVYYCARNYRYFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 167 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacgacggcggcaccatctacgcccagaaattccagggcagagtgaccatgaccgtggacacctccacctccaccgtgtacatggaactgtcctccctgcggagcgaggacaccgccgtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 168 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNDGGTIYAQKFQGRVTMTVDTSTSTVYMELSSLRSEDTAVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 169 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaactccggcggcaccatctacgcccagaaattccagggcagagtgaccatgaccgtggacacctccacctccaccgtgtacatggaactgtcctccctgcggagcgaggacaccgccgtgtactactgcgcccggaactaccggcagttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 170 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNSGGTIYAQKFQGRVTMTVDTSTSTVYMELSSLRSEDTAVYYCARNYRQFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 171 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaactccggcggcaccatctacgcccagaaattccagggcagagtgaccatgaccgtggacacctccacctccaccgtgtacatggaactgtcctccctgcggagcgaggacaccgccgtgtactactgcgcccggaactaccggtccttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 172 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNSGGTIYAQKFQGRVTMTVDTSTSTVYMELSSLRSEDTAVYYCARNYRSFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 173 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaactccggcggcaccatctacgcccagaaattccagggcagagtgaccatgaccgtggacacctccacctccaccgtgtacatggaactgtcctccctgcggagcgaggacaccgccgtgtactactgcgcccggaactaccggtacttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 174 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNSGGTIYAQKFQGRVTMTVDTSTSTVYMELSSLRSEDTAVYYCARNYRYFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 175 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaactccggcggcaccatctacgcccagaaattccagggcagagtgaccatgaccgtggacacctccacctccaccgtgtacatggaactgtcctccctgcggagcgaggacaccgccgtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 176 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNSGGTIYAQKFQGRVTMTVDTSTSTVYMELSSLRSEDTAVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 177 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacaacggcggcaccatctacgcccagaaattccagggcagagtgaccatgaccgtggacacctccacctccaccgtgtacatggaactgtcctccctgcggagcgaggacaccgccgtgtactactgcgcccggaactaccggcagttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 178 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNNGGTIYAQKFQGRVTMTVDTSTSTVYMELSSLRSEDTAVYYCARNYRQFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 179 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacaacggcggcaccatctacgcccagaaattccagggcagagtgaccatgaccgtggacacctccacctccaccgtgtacatggaactgtcctccctgcggagcgaggacaccgccgtgtactactgcgcccggaactaccggtccttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 180 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNNGGTIYAQKFQGRVTMTVDTSTSTVYMELSSLRSEDTAVYYCARNYRSFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 181 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagggcctggaatggatgggcgacatcaaccccaacaacggcggcaccatctacgcccagaaattccagggcagagtgaccatgaccgtggacacctccacctccaccgtgtacatggaactgtcctccctgcggagcgaggacaccgccgtgtactactgcgcccggaactaccggtacttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 182 - protein, 446 aa, Artificial Sequence
  Description of Artificial Sequence: Synthetic polypeptide
QVQLVQSGAEVKKPGASVKVSCKASGYTFTDYNVDWVRQAPGQGLEWMGDINPNNGGTIYAQKFQGRVTMTVDTSTSTVYMELSSLRSEDTAVYYCARNYRYFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 183 - DNA, 1398 bp, Artificial Sequence; identical to SEQ ID NO: 127
  Description of Artificial Sequence: Synthetic polynucleotide

SEQ ID NO: 184 - protein, 446 aa, Artificial Sequence; identical to SEQ ID NO: 128
  Description of Artificial Sequence: Synthetic polypeptide

SEQ ID NO: 185 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagcggctggaatggatgggcgacatcaaccccaacgacggcggcaccatctactcccagaaattccagggcagagtgaccatcaccgtggacacctccgcctccaccgcctacatggaactgtcctccctgcggagcgaggacaccgccgtgtactactgcgcccggaactaccggcagttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 186 - protein, 446 aa, Artificial Sequence
  Description of Artificial Sequence: Synthetic polypeptide
QVQLVQSGAEVKKPGASVKVSCKASGYTFTDYNVDWVRQAPGQRLEWMGDINPNDGGTIYSQKFQGRVTITVDTSASTAYMELSSLRSEDTAVYYCARNYRQFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 187 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagcggctggaatggatgggcgacatcaaccccaacgacggcggcaccatctactcccagaaattccagggcagagtgaccatcaccgtggacacctccgcctccaccgcctacatggaactgtcctccctgcggagcgaggacaccgccgtgtactactgcgcccggaactaccggtccttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 188 - protein, 446 aa, Artificial Sequence
  Description of Artificial Sequence: Synthetic polypeptide
QVQLVQSGAEVKKPGASVKVSCKASGYTFTDYNVDWVRQAPGQRLEWMGDINPNDGGTIYSQKFQGRVTITVDTSASTAYMELSSLRSEDTAVYYCARNYRSFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 189 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagcggctggaatggatgggcgacatcaaccccaacgacggcggcaccatctactcccagaaattccagggcagagtgaccatcaccgtggacacctccgcctccaccgcctacatggaactgtcctccctgcggagcgaggacaccgccgtgtactactgcgcccggaactaccggtacttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 190 - protein, 465 aa, Artificial Sequence
  Description of Artificial Sequence: Synthetic polypeptide
MEWSWVFLFFLSVTTGVHSQVQLVQSGAEVKKPGASVKVSCKASGYTFTDYNVDWVRQAPGQRLEWMGDINPNDGGTIYSQKFQGRVTITVDTSASTAYMELSSLRSEDTAVYYCARNYRYFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 191 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagcggctggaatggatgggcgacatcaaccccaacgacggcggcaccatctactcccagaaattccagggcagagtgaccatcaccgtggacacctccgcctccaccgcctacatggaactgtcctccctgcggagcgaggacaccgccgtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 192 - protein, 446 aa, Artificial Sequence
  Description of Artificial Sequence: Synthetic polypeptide
QVQLVQSGAEVKKPGASVKVSCKASGYTFTDYNVDWVRQAPGQRLEWMGDINPNDGGTIYSQKFQGRVTITVDTSASTAYMELSSLRSEDTAVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 193 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagcggctggaatggatgggcgacatcaaccccaactccggcggcaccatctactcccagaaattccagggcagagtgaccatcaccgtggacacctccgcctccaccgcctacatggaactgtcctccctgcggagcgaggacaccgccgtgtactactgcgcccggaactaccggcagttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 194 - protein, 446 aa, Artificial Sequence
  Description of Artificial Sequence: Synthetic polypeptide
QVQLVQSGAEVKKPGASVKVSCKASGYTFTDYNVDWVRQAPGQRLEWMGDINPNSGGTIYSQKFQGRVTITVDTSASTAYMELSSLRSEDTAVYYCARNYRQFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 195 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagcggctggaatggatgggcgacatcaaccccaactccggcggcaccatctactcccagaaattccagggcagagtgaccatcaccgtggacacctccgcctccaccgcctacatggaactgtcctccctgcggagcgaggacaccgccgtgtactactgcgcccggaactaccggtccttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 196 - protein, 446 aa, Artificial Sequence
  Description of Artificial Sequence: Synthetic polypeptide
QVQLVQSGAEVKKPGASVKVSCKASGYTFTDYNVDWVRQAPGQRLEWMGDINPNSGGTIYSQKFQGRVTITVDTSASTAYMELSSLRSEDTAVYYCARNYRSFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 197 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagcggctggaatggatgggcgacatcaaccccaactccggcggcaccatctactcccagaaattccagggcagagtgaccatcaccgtggacacctccgcctccaccgcctacatggaactgtcctccctgcggagcgaggacaccgccgtgtactactgcgcccggaactaccggtacttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 198 - protein, 446 aa, Artificial Sequence
  Description of Artificial Sequence: Synthetic polypeptide
QVQLVQSGAEVKKPGASVKVSCKASGYTFTDYNVDWVRQAPGQRLEWMGDINPNSGGTIYSQKFQGRVTITVDTSASTAYMELSSLRSEDTAVYYCARNYRYFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 199 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagcggctggaatggatgggcgacatcaaccccaacaacggcggcaccatctactcccagaaattccagggcagagtgaccatcaccgtggacacctccgcctccaccgcctacatggaactgtcctccctgcggagcgaggacaccgccgtgtactactgcgcccggaactaccggcagttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 200 - protein, 446 aa, Artificial Sequence
  Description of Artificial Sequence: Synthetic polypeptide
QVQLVQSGAEVKKPGASVKVSCKASGYTFTDYNVDWVRQAPGQRLEWMGDINPNNGGTIYSQKFQGRVTITVDTSASTAYMELSSLRSEDTAVYYCARNYRQFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 201 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagcggctggaatggatgggcgacatcaaccccaacaacggcggcaccatctactcccagaaattccagggcagagtgaccatcaccgtggacacctccgcctccaccgcctacatggaactgtcctccctgcggagcgaggacaccgccgtgtactactgcgcccggaactaccggtccttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 202 - protein, 446 aa, Artificial Sequence
  Description of Artificial Sequence: Synthetic polypeptide
QVQLVQSGAEVKKPGASVKVSCKASGYTFTDYNVDWVRQAPGQRLEWMGDINPNNGGTIYSQKFQGRVTITVDTSASTAYMELSSLRSEDTAVYYCARNYRSFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 203 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagcggctggaatggatgggcgacatcaaccccaacaacggcggcaccatctactcccagaaattccagggcagagtgaccatcaccgtggacacctccgcctccaccgcctacatggaactgtcctccctgcggagcgaggacaccgccgtgtactactgcgcccggaactaccggtacttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 204 - protein, 446 aa, Artificial Sequence
  Description of Artificial Sequence: Synthetic polypeptide
QVQLVQSGAEVKKPGASVKVSCKASGYTFTDYNVDWVRQAPGQRLEWMGDINPNNGGTIYSQKFQGRVTITVDTSASTAYMELSSLRSEDTAVYYCARNYRYFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 205 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccaggacagcggctggaatggatgggcgacatcaaccccaacaacggcggcaccatctactcccagaaattccagggcagagtgaccatcaccgtggacacctccgcctccaccgcctacatggaactgtcctccctgcggagcgaggacaccgccgtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 206 - protein, 446 aa, Artificial Sequence
  Description of Artificial Sequence: Synthetic polypeptide
QVQLVQSGAEVKKPGASVKVSCKASGYTFTDYNVDWVRQAPGQRLEWMGDINPNNGGTIYSQKFQGRVTITVDTSASTAYMELSSLRSEDTAVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 207 - DNA, 717 bp, Artificial Sequence; identical to SEQ ID NO: 135
  Description of Artificial Sequence: Synthetic polynucleotide

SEQ ID NO: 208 - protein, 218 aa, Artificial Sequence; identical to SEQ ID NO: 136
  Description of Artificial Sequence: Synthetic polypeptide

SEQ ID NO: 209 - DNA, 717 bp, Artificial Sequence; identical to SEQ ID NO: 137
  Description of Artificial Sequence: Synthetic polynucleotide

SEQ ID NO: 210 - protein, 218 aa, Artificial Sequence; identical to SEQ ID NO: 138
  Description of Artificial Sequence: Synthetic polypeptide

SEQ ID NO: 211 - DNA, 1398 bp, Artificial Sequence
  Description of Artificial Sequence: Synthetic polynucleotide
atggaatggtcctgggtgttcctgttcttcctgtccgtgaccaccggcgtgcactccgaggtgctgctgctgcagtctggccccgaactggtgaaacctggaacctccgtgaagatcccctgcaaggcctccggctacaccttcaccgactacaacgtggactgggtcaagcagcggcacggaaagggcctggaatggatcggcgacatcaaccccaacaacggcggcaccatctactcccagaaattcaagggcaaggccaccctgaccgtggacaagagttcctccaccgccttcatggaactgcggtccctgaccagcgaggataccgccgtgtacttctgcgcccggaactaccggtggttcggcgccatggatcactggggccagggcacctccgtgacagtgtcctctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 212 - protein, 446 aa, Artificial Sequence
  Description of Artificial Sequence: Synthetic polypeptide
EVLLLQSGPELVKPGTSVKIPCKASGYTFTDYNVDWVKQRHGKGLEWIGDINPNNGGTIYSQKFKGKATLTVDKSSSTAFMELRSLTSEDTAVYFCARNYRWFGAMDHWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 213 - DNA, 1398 bp, Artificial Sequence; identical to SEQ ID NO: 157
  Description of Artificial Sequence: Synthetic polynucleotide

SEQ ID NO: 214 - protein, 465 aa, Artificial Sequence
  Description of Artificial Sequence: Synthetic polypeptide
MEWSWVFLFFLSVTTGVHSQVQLVQSGAEVKKPGASVKVSCKASGYTFTDYNVDWVRQAPGQGLEWMGDINPNNGGTIYAQKFQGRVTSTVDTSISTAYMELSRLRSDDTVVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 215 - DNA, 1398 bp, Artificial Sequence; identical to SEQ ID NO: 205
  Description of Artificial Sequence: Synthetic polynucleotide

SEQ ID NO: 216 - protein, 446 aa, Artificial Sequence; identical to SEQ ID NO: 206
  Description of Artificial Sequence: Synthetic polypeptide

SEQ ID NO: 217 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggcgcctccgtgaaggtgtcctgcaaggcctccggctacaccttcaccgactacaacgtggactgggtccgacaggccccagggaagggcctggaatggatgggcgacatcaaccccaacaacggcggcaccatctacgcccagaaattccagggcagagtgaccatgaccgtggacacctccaccgacaccgcctacatggaactgtcctccctgcggagcgaggacaccgccgtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 218 - protein, 446 aa, Artificial Sequence
  Description of Artificial Sequence: Synthetic polypeptide
QVQLVQSGAEVKKPGASVKVSCKASGYTFTDYNVDWVRQAPGKGLEWMGDINPNNGGTIYAQKFQGRVTMTVDTSTDTAYMELSSLRSEDTAVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 219 - DNA, 1398 bp, Artificial Sequence
  Description of Artificial Sequence: Synthetic polynucleotide
atggaatggtcctgggtgttcctgttcttcctgtccgtgaccaccggcgtgcactcccaggtgcagctggtgcagtctggcgccgaagtgaagaaacctggctcctccgtgaaggtgtcctgcaaggcctccggctacaccttcaccgactacaacgtggactgggtccgacaggccccaggacagggcctggaatggatgggcgacatcaaccccaacaacggcggcaccatctacgcccagaaattccagggcagagtgaccatcaccgtggacaagtccacctccaccgcctacatggaactgtcctccctgcggagcgaggacaccgccgtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 220 - protein, 446 aa, Artificial Sequence
  Description of Artificial Sequence: Synthetic polypeptide
QVQLVQSGAEVKKPGSSVKVSCKASGYTFTDYNVDWVRQAPGQGLEWMGDINPNNGGTIYAQKFQGRVTITVDKSTSTAYMELSSLRSEDTAVYYCARNYRWFGAMDHWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 221 - DNA, 1398 bp, Artificial Sequence
  Description of Artificial Sequence: Synthetic polynucleotide
atggaatggtcctgggtgttcctgttcttcctgtccgtgaccaccggcgtgcactcccagatgcagctggtgcagtctggccccgaagtgaagaaacctggcacctccgtgaaggtgtcctgcaaggcctccggctacaccttcaccgactacaacgtggactgggtccgacaggctagaggacagcggctggaatggatcggcgacatcaaccccaacaacggcggcaccatctacgcccagaaattccaagagagagtgaccatcaccgtcgataagtccacctccaccgcctacatggaactgtcctccctgcggagcgaggacaccgccgtgtactactgcgcccggaactaccggtggttcggcgccatggatcactggggccagggcaccaccgtgaccgtgtcgtctgcctccaccaagggcccctccgtgttccctctggccccttgctcccggtccacctccgagtctaccgccgctctgggctgcctggtgaaagactacttccccgagcctgtgaccgtgtcctggaactctggcgccctgacctctggcgtgcacaccttccctgccgtgctgcagtcctccggcctgtactccctgtcctccgtggtgacagtgccctcctccagcctgggcaccaagacctacacctgtaacgtggaccacaagccctccaacaccaaggtggacaagcgggtggaatctaagtacggccctccctgccccccctgccctgccccagaatttctgggaggcccttccgtgtttctgttccccccaaagcccaaggacaccctgatgatctcccggacccccgaagtgacctgcgtggtggtggacgtgtcccaagaagatcccgaggtccagttcaattggtacgtggacggcgtggaagtgcacaacgccaagaccaagcccagagaggaacagttcaactccacctaccgggtggtgtccgtgctgaccgtgctgcaccaggactggctgaacggcaaagaatacaagtgcaaagtctccaacaagggcctgccctccagcatcgaaaagaccatctccaaggccaagggccagcctcgcgagccccaggtgtacaccctgccccctagccaagaagagatgaccaagaaccaggtgtccctgacctgtctggtgaaaggcttctacccctccgatatcgccgtggaatgggagtccaacggccagcccgagaacaactacaagaccaccccccctgtgctggactccgacggctccttcttcctgtactctcggctgaccgtggacaagtcccggtggcaagaaggcaacgtcttctcctgctctgtgatgcacgaggccctgcacaaccactacacccagaagtccctgtccctgagcctgggcaagtga

SEQ ID NO: 222 - protein, 446 aa, Artificial Sequence; identical to SEQ ID NO: 114
  Description of Artificial Sequence: Synthetic polypeptide

SEQ ID NO: 223 - DNA, 717 bp, Artificial Sequence
  Description of Artificial Sequence: Synthetic polynucleotide
atgtccgtgcccacccaggtgctgggactgctgctgctgtggctgaccgacgccagatgcgacatcgtgctgacccagtcccccgcctccctggctgtgtctcctggccagagagccaccatcagctgcaaggcctcccagtccctggactacgagggcgactccgacatgaactggtatcagcagaagcccggccagcctcctcggctgctgatctctggcgcctccaacctggaatccggcatccctgcccggttctccggctctggctctggcaccgacttcaccgtgaacatccaccccgtggaagaagaggacgccgccacctactactgccagcagtccaccgaggacccccggacctttggcggaggcaccaagctggaaatcaagcggaccgtggccgctccctccgtgttcatcttcccaccctccgacgagcagctgaagtccggcaccgcctccgtggtctgcctgctgaacaacttctaccctcgcgaggccaaggtgcagtggaaggtggacaacgccctgcagtccggcaactcccaagaatccgtgaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgctga

SEQ ID NO: 224 - protein, 218 aa, Artificial Sequence
  Description of Artificial Sequence: Synthetic polypeptide
DIVLTQSPASLAVSPGQRATISCKASQSLDYEGDSDMNWYQQKPGQPPRLLISGASNLESGIPARFSGSGSGTDFTVNIHPVEEEDAATYYCQQSTEDPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 225 - DNA, 717 bp, Artificial Sequence; identical to SEQ ID NO: 135
  Description of Artificial Sequence: Synthetic polynucleotide

SEQ ID NO: 226 - protein, 218 aa, Artificial Sequence; identical to SEQ ID NO: 136
  Description of Artificial Sequence: Synthetic polypeptide

SEQ ID NO: 227 - DNA, 717 bp, Artificial Sequence
  Description of Artificial Sequence: Synthetic polynucleotide
atgtccgtgcccacccaggtgctgggactgctgctgctgtggctgaccgacgccagatgcgacatcgtgatgacccagacccccctgtcctcccctgtgacactgggccagcctgcctccatctcctgcaaggcctcccagtccctggactacgagggcgactccgacatgaactggctgcagcagcggcctggccagcctcctcggctgctgatctacggcgcctccaacctggaatccggcgtgcccgacagattctctggctccggcgctggcaccgacttcaccctgaagatcagccgggtggaagccgaggacgtgggcgtgtactactgccagcagtccaccgaggacccccggacctttggcggaggcaccaaggtggaaatcaagcggaccgtggccgctccctccgtgttcatcttcccaccctccgacgagcagctgaagtccggcaccgcctccgtggtctgcctgctgaacaacttctaccctcgcgaggccaaggtgcagtggaaggtggacaacgccctgcagtccggcaactcccaagaatccgtgaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgctga

SEQ ID NO: 228 - protein, 218 aa, Artificial Sequence
  Description of Artificial Sequence: Synthetic polypeptide
DIVMTQTPLSSPVTLGQPASISCKASQSLDYEGDSDMNWLQQRPGQPPRLLIYGASNLESGVPDRFSGSGAGTDFTLKISRVEAEDVGVYYCQQSTEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 229 - DNA, 717 bp, Artificial Sequence
  Description of Artificial Sequence: Synthetic polynucleotide
atgtccgtgcccacccaggtgctgggactgctgctgctgtggctgaccgacgccagatgcgacatcgtgatgacccagtcccccgactccctggccgtgtctctgggcgagagagccaccatcaactgcaaggcctcccagtccctggactacgagggcgactccgacatgaactggtatcagcagaagcccggccagccccccaagctgctgatctacggcgcctccaacctggaatccggcgtgcccgacagattctccggctccggctctggcaccgacttcaccctgaccatcagctccctgcaggccgaggacgtggccgtgtactactgccagcagtccaccgaggacccccggacctttggcggaggcaccaaggtggaaatcaagcggaccgtggccgctccctccgtgttcatcttcccaccctccgacgagcagctgaagtccggcaccgcctccgtggtctgcctgctgaacaacttctaccctcgcgaggccaaggtgcagtggaaggtggacaacgccctgcagtccggcaactcccaagaatccgtgaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgctga

SEQ ID NO: 230 - protein, 218 aa, Artificial Sequence
  Description of Artificial Sequence: Synthetic polypeptide
DIVMTQSPDSLAVSLGERATINCKASQSLDYEGDSDMNWYQQKPGQPPKLLIYGASNLESGVPDRFSGSGSGTDFTLTISSLQAEDVAVYYCQQSTEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 231 - DNA, 717 bp, Artificial Sequence
  Description of Artificial Sequence: Synthetic polynucleotide
atgtccgtgcccacccaggtgctgggactgctgctgctgtggctgaccgacgccagatgcgacatcgtgatgacccagtcccccctgtccctgcctgtgacacctggcgagcctgcctccatctcctgcaaggcctcccagtccctggactacgagggcgactccgacatgaactggtatctgcagaagcccggccagtcccctcagctgctgatctacggcgcctccaacctggaatccggcgtgcccgacagattctccggctccggctctggcaccgacttcaccctgaagatcagccgggtggaagccgaggacgtgggcgtgtactactgccagcagtccaccgaggacccccggacctttggcggaggcaccaaggtggaaatcaagcggaccgtggccgctccctccgtgttcatcttcccaccctccgacgagcagctgaagtccggcaccgcctccgtggtctgcctgctgaacaacttctaccctcgcgaggccaaggtgcagtggaaggtggacaacgccctgcagtccggcaactcccaagaatccgtgaccgagcaggactccaaggacagcacctactccctgtcctccaccctgaccctgtccaaggccgactacgagaagcacaaggtgtacgcctgcgaagtgacccaccagggcctgtccagccccgtgaccaagtccttcaaccggggcgagtgctga

SEQ ID NO: 232 - protein, 218 aa, Artificial Sequence
  Description of Artificial Sequence: Synthetic polypeptide
DIVMTQSPLSLPVTPGEPASISCKASQSLDYEGDSDMNWYLQKPGQSPQLLIYGASNLESGVPDRFSGSGSGTDFTLKISRVEAEDVGVYYCQQSTEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 233 - DNA, 1410 bp, Artificial Sequence
  Description of Artificial Sequence: Synthetic polynucleotide
atggagtggagctgggtgttcctgttcttcctgagcgtgaccacaggcgtgcacagccaggtgcagctcgtgcagagcggcgctgaagtgaagaagcccggcgccagcgtgaaagtgagctgcaaggccagcggctacaccctgaccgactactggatgcattgggtgagacaggctcctggacagggcctggagtggatgggcatcatcgacatcagcgacagctactccagctacgcccagaagttccagggcagggtgaccatgaccagggacacctccacctccaccgtgtacatggagctgagcagcctgaggagcgaggacaccgccgtgtactactgcgccaggagccccttctacaacagcaggggcggcaactacttcgactactggggacagggcaccaccgtgaccgtgtcgagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 234 - protein, 123 aa, Artificial Sequence
  Description of Artificial Sequence: Synthetic polypeptide
QVQLVQSGAEVKKPGASVKVSCKASGYTLTDYWMHWVRQAPGQGLEWMGIIDISDSYSSYAQKFQGRVTMTRDTSTSTVYMELSSLRSEDTAVYYCARSPFYNSRGGNYFDYWGQGTTVTVSS

SEQ ID NO: 235 - protein, 469 aa, Artificial Sequence
  Description of Artificial Sequence: Synthetic polypeptide
MEWSWVFLFFLSVTTGVHSQVQLVQSGAEVKKPGASVKVSCKASGYTLTDYWMHWVRQAPGQGLEWMGIIDISDSYSSYAQKFQGRVTMTRDTSTSTVYMELSSLRSEDTAVYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 236 - DNA, 1419 bp, Artificial Sequence
  Description of Artificial Sequence: Synthetic polynucleotide
atggagtggtcctgggtgttcctgtttttcctgtccgtgaccaccggcgtgcacagcgaggtccagctggtgcagagcggcgccgaagtcaagaaacctggcgagagcctgagaatttcctgcaagggcagcggctataccctgaccgactactggatgcactgggtgagacagctgcccggcaagggcctggagtggatgggcgccatcgacattagcgactcctacacctcctactcccccagcttccagggccacgtgacaatctccgtggataagagcatcagcaccgcctatctccagtggtccagcctgaaggccagcgacaccgccatgtactactgcgccagaagccccttttacaactccaggggcggcaactacttcgactactggggccaaggaaccaccgtcacagtgtcttccgccagcaccaagggaccctccgtcttccccctggctcctagcagcaagagcacctccggcggaacagctgccctgggatgtctcgtgaaggattactttcccgagcctgtcaccgtgtcctggaacagcggagccctgaccagcggcgtgcatacattccccgccgtgctgcagagcagcggactgtactccctgtcctccgtggtgacagtgccttcctccagcctgggcacccagacctatatttgcaacgtgaaccacaagcccagcaacaccaaggtggacaagaaggtggagcccaagtcctgcgacaaaacacacacctgccctccctgtcctgctcccgaactcctcggaggcccttccgtgttcctgttcccccccaagcccaaggacaccctgatgattagcagaacccccgaagtgacctgtgtggtggtcgatgtctcccatgaggaccccgaggtcaaattcaactggtacgtggacggcgtggaggtccacaatgccaaaaccaagcccagggaggagcagtataacagcacctacagggtggtgagcgtgctgaccgtgctgcaccaggactggctgaacggcaaggagtacaagtgcaaggtgtccaacaaggccctgcctgcccccattgagaagaccatctccaaggccaagggccagcctagggagccccaggtgtacaccctccctccctccagggacgagctgaccaagaaccaggtctccctgacctgcctggtgaagggcttttatcccagcgacatcgccgtggagtgggaaagcaacggccagcccgagaacaattacaagaccaccccccccgtgctggacagcgatggcagcttcttcctgtacagcaagctgacagtggacaagtccaggtggcaacagggcaatgtcttctcctgcagcgtgatgcacgaggccctgcacaaccactatacccagaaatccctcagcctgtcccctggaaagtga

SEQ ID NO: 237 - protein, 453 aa, Artificial Sequence
  Description of Artificial Sequence: Synthetic polypeptide
EVQLVQSGAEVKKPGESLRISCKGSGYTLTDYWMHWVRQLPGKGLEWMGAIDISDSYTSYSPSFQGHVTISVDKSISTAYLQWSSLKASDTAMYYCARSPFYNSRGGNYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - DNA, 1410 bp, Artificial Sequence
  Description of Artificial Sequence: Synthetic polynucleotide
atggagtggagctgggtgttcctgttcttcctgagcgtgaccaccggcgtgcacagcgaggtgcagctggtccagagcggagccgaggtgaagaagcccggcgagagcctgagaatcagctgcaaaggcagcggctacaccctgaccgattactggatgcactgggtgaggcagctgcctggcaagggcctggagtggatgggcgccatcgacatcagcgacagctacaccagctacagccccagcttccagggccacgtgaccatcagcgtggacaagagcatcagcaccgcctacctgcagtggagcagcctgaaggccagcgacaccgccatgtactattgcgccaggagccccttctacaactccaggggcggcaactacttcgactactggggccagggcacaaccgtgaccgtgtcgtccgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 239 - protein, 450 aa, Artificial Sequence
  Description of Artificial Sequence: Synthetic polypeptide
EVQLVQSGAEVKKPGESLRISCKGSGYTLTDYWMHWVRQLPGKGLEWMGAIDISDSYTSYSPSFQGHVTISVDKSISTAYLQWSSLKASDTAMYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 240 - DNA, 708 bp, Artificial Sequence
  Description of Artificial Sequence: Synthetic polynucleotide
atgagcgtgcccacccaagtgctgggcctgctgctgctgtggctgaccgacgccaggtgcgacatccagatgacccagagccctagcagcctgagcgccagcgtgggagacagggtgaccatcacctgcagggccagccaggacatcagcaactacctgaactggtaccagcagaagcccggcaaggtgcccaagctgctgatctactacaccagcaggctgcacagcggagtgcccagcagatttagcggcagcggcagcggcacagactacaccctgaccatcagctccctgcagcccgaggacgtggccacctactactgccagcagggcgataccctgcccccttggacatttggcggcggcaccaaggtggagatcaagcgtacggtggctgccccctccgtgttcatcttcccccccagcgatgagcagctgaagagcggcacagccagcgtggtgtgcctgctgaacaacttctaccccagggaggccaaggtgcagtggaaggtggacaacgccctgcagagcggcaacagccaggagtccgtgaccgagcaggacagcaaggacagcacctacagcctgagcagcacactgaccctgagcaaggccgactacgagaagcacaaggtgtacgcctgcgaggtgacccatcagggcctgagcagccccgtgaccaagagcttcaacaggggcgagtgctga

SEQ ID NO: 241 - protein, 215 aa, Artificial Sequence
  Description of Artificial Sequence: Synthetic polypeptide
DIQMTQSPSSLSASVGDRVTITCRASQDISNYLNWYQQKPGKVPKLLIYYTSRLHSGVPSRFSGSGSGTDYTLTISSLQPEDVATYYCQQGDTLPPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 242 - DNA, 1410 bp, Artificial Sequence
  Description of Artificial Sequence: Synthetic polynucleotide
atggagtggagctgggtgttcctgttcttcctgagcgtgaccaccggcgtgcatagccaggtgcagctggtgcagagcggcgctgaggtgaaaaagcccggcgccagcgtgaaggtgagctgcaaggccagcggctacaccctgaccgactactggatgcattgggtgagacaggcccctggacagggcctggaatggatgggcgccatcgacatcagcgactcctacaccagctacgcccagaagtttcagggcagggtgaccatgaccgtggacaccagcaccagcaccgtctacatggagctgagcagcctgaggagcgaggacaccgccgtgtactactgcgccaggagccccttctacaacagcaggggcggcaactacttcgactactggggccagggcaccacagtgaccgtgtcgtccgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 243 - protein, 450 aa, Artificial Sequence
  Description of Artificial Sequence: Synthetic polypeptide
QVQLVQSGAEVKKPGASVKVSCKASGYTLTDYWMHWVRQAPGQGLEWMGAIDISDSYTSYAQKFQGRVTMTVDTSTSTVYMELSSLRSEDTAVYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 244 - DNA, 1410 bp, Artificial Sequence
  Description of Artificial Sequence: Synthetic polynucleotide
atggagtggagctgggtgttcctgttcttcctgagcgtgaccaccggcgtgcacagcgaggtgcagctggtccagagcggagccgaggtgaagaagcccggcgagagcctgaaaatcagctgcaaaggcagcggctacaccctgaccgattactggatgcactgggtgaggcagctgcctggcaagggcctggagtggatgggcgccatcgacatcagcgacagctacaccagctacagccccagcttccagggccaagtgaccatcagcgtggacaagagcatcagcaccgcctacctgcagtggagcagcctgaaggccagcgacaccgccatgtactattgcgccaggagccccttctacaactccaggggcggcaactacttcgactactggggccagggcacaaccgtgaccgtgtcgtccgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 245 - protein, 450 aa, Artificial Sequence
  Description of Artificial Sequence: Synthetic polypeptide
EVQLVQSGAEVKKPGESLKISCKGSGYTLTDYWMHWVRQLPGKGLEWMGAIDISDSYTSYSPSFQGQVTISVDKSISTAYLQWSSLKASDTAMYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 246 - DNA, 1410 bp, Artificial Sequence
  Description of Artificial Sequence: Synthetic polynucleotide
atggagtggtcctgggtgttcctgttcttcctgtccgtgaccaccggcgtgcacagcgaggtgcagctggtggaatccggaggcggactggtgcagcctggaggaagcctgagactgagctgcgctgcctccggctacaccctgaccgactactggatgcactgggtgagacaggcccctggcaagggactggtgtgggtgtccgccatcgacatcagcgacagctacaccagctacgctgacagcgtgaagggcaggttcaccatctccgtggacaacgccaagaacaccctgtacctgcagatgaacagcctgagagccgaggacaccgccgtgtactattgcgccagaagccccttctacaacagcaggggcggcaactacttcgactactggggacagggcaccaccgtgaccgtgtcgagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 247 - protein, 450 aa, Artificial Sequence
  Description of Artificial Sequence: Synthetic polypeptide
EVQLVESGGGLVQPGGSLRLSCAASGYTLTDYWMHWVRQAPGKGLVWVSAIDISDSYTSYADSVKGRFTISVDNAKNTLYLQMNSLRAEDTAVYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 248 - DNA, 1410 bp, Artificial Sequence
  Description of Artificial Sequence: Synthetic polynucleotide
atggagtggagctgggtcttcctgttcttcctgagcgtgaccaccggcgtgcacagccaggtgcagctggtggagagcggaggaggcctggtgaagcctggaggcagcctgaggctgagctgtgctgccagcggctacaccctgaccgactactggatgcactggatcaggcaggcccctggaaagggcctggagtgggtgagcgccatcgacatcagcgacagctacatcagctacgccgacagcgtgaagggcaggttcaccatcagcgtggacaacgccaagaacagcctgtacctgcagatgaacagcctcagggccgaggataccgccgtgtactactgcgccaggagccccttctacaacagcaggggcggcaactacttcgactactggggccagggaaccacagtgaccgtgtcgagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 249 - protein, 450 aa, Artificial Sequence
  Description of Artificial Sequence: Synthetic polypeptide
QVQLVESGGGLVKPGGSLRLSCAASGYTLTDYWMHWIRQAPGKGLEWVSAIDISDSYISYADSVKGRFTISVDNAKNSLYLQMNSLRAEDTAVYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 250 - DNA, 1431 bp, Artificial Sequence
  Description of Artificial Sequence: Synthetic polynucleotide
atggagtggtcctgggtgttcctgttcttcctgagcgtgaccaccggcgtgcactccgaggtgcagctggtgcagagcggcgctgaggtgaagaagcccggcgagtccctgaagatcagctgcaagggcagcggcagcagcttcaccgactactacatcaactgggtgaggcagatgcctggcaagggcctggagtggatgggctggatctaccccggcagcggcaacaccatctactcccccagcttccagggccaggtgaccatcagcgtggacaagagcatcagcaccgcctacctgcagtggagcagcctgaaggccagcgacaccgccatgtactactgcgccagggaggccgactacgatgacgccctggactattggggccagggcaccaccgtgacagtgtcgagctggggccagggaaccaccgtgaccgtgtcgagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 251 - protein, 457 aa, Artificial Sequence
  Description of Artificial Sequence: Synthetic polypeptide
EVQLVQSGAEVKKPGESLKISCKGSGSSFTDYYINWVRQMPGKGLEWMGWIYPGSGNTIYSPSFQGQVTISVDKSISTAYLQWSSLKASDTAMYYCAREADYDDALDYWGQGTTVTVSSWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 252 - DNA, 1398 bp, Artificial Sequence
  Description of Artificial Sequence: Synthetic polynucleotide
atggagtggagctgggtgttcctgttcttcctgagcgtgaccaccggcgtgcactcccaggtgcagctggtgcagagcggagccgaggtgaagaagcctggcgccagcgtgaaggtgtcctgcaaggccagcggcagctccttcaccgactactacatcaactgggtgaggcaggcccctggacagggactggagtggatgggctggatttaccccggcagcggcaacaccatctacgcccagaagttccagggcagggtgaccagcaccgtggacaccagcatcagcaccgcctacatggagctgagcaggctgaggagcgacgacaccgtggtgtactactgcgccagggaggccgactacgacgatgccctggactactggggccagggcaccacagtgaccgtgtcgagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 253 - protein, 446 aa, Artificial Sequence
  Description of Artificial Sequence: Synthetic polypeptide
QVQLVQSGAEVKKPGASVKVSCKASGSSFTDYYINWVRQAPGQGLEWMGWIYPGSGNTIYAQKFQGRVTSTVDTSISTAYMELSRLRSDDTVVYYCAREADYDDALDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 254 - DNA, 1410 bp, Artificial Sequence
  Description of Artificial Sequence: Synthetic polynucleotide
atggagtggagctgggtgttcctgttcttcctgagcgtgaccaccggcgtgcacagccaggtgcagctggtgcagagcggagccgaggtgaagaagcccggcgcgagcgtgaaggtgagctgcaaggtgagcggctacaccctgaccgactactggatgcactgggtgagacaggcccccggaaagggcctggaatggatgggcgccatcgacatcagcgacagctacacaagctacgcccagaagttccagggcagggtgaccatgaccgtggacaccagcaccgacaccgcctacatggagctgagcagcctgaggagcgaggacacagccgtctactactgcgccaccagccccttctacaacagcaggggcggcaactacttcgactactggggccagggcaccacagtgaccgtgtcgtccgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 255 - protein, 450 aa, Artificial Sequence
  Description of Artificial Sequence: Synthetic polypeptide
QVQLVQSGAEVKKPGASVKVSCKVSGYTLTDYWMHWVRQAPGKGLEWMGAIDISDSYTSYAQKFQGRVTMTVDTSTDTAYMELSSLRSEDTAVYYCATSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 256 - DNA, 708 bp, Artificial Sequence
  Description of Artificial Sequence: Synthetic polynucleotide
atgagcgtgcccacccaagtgctgggcctgctgctgctgtggctgaccgacgccaggtgcgacatccagatgacccagagccctagcagcctgagcgccagcgtgggagacagggtgaccatcacctgcagggccagccaggacatcagcaactacctgaactggtaccagcagaagcccggcaaggcccccaagctgctgatctactacaccagcaggctgcacagcggagtgcccagcagatttagcggcagcggcagcggcacagactacaccttcaccatcagctccctgcagcccgaggacatcgccacctactactgccagcagggcgataccctgcccccttggacatttggcggcggcaccaaggtggagatcaagcgtacggtggctgccccctccgtgttcatcttcccccccagcgatgagcagctgaagagcggcacagccagcgtggtgtgcctgctgaacaacttctaccccagggaggccaaggtgcagtggaaggtggacaacgccctgcagagcggcaacagccaggagtccgtgaccgagcaggacagcaaggacagcacctacagcctgagcagcacactgaccctgagcaaggccgactacgagaagcacaaggtgtacgcctgcgaggtgacccatcagggcctgagcagccccgtgaccaagagcttcaacaggggcgagtgctga

SEQ ID NO: 257 - protein, 215 aa, Artificial Sequence
  Description of Artificial Sequence: Synthetic polypeptide
DIQMTQSPSSLSASVGDRVTITCRASQDISNYLNWYQQKPGKAPKLLIYYTSRLHSGVPSRFSGSGSGTDYTFTISSLQPEDIATYYCQQGDTLPPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 258 - DNA, 708 bp, Artificial Sequence
  Description of Artificial Sequence: Synthetic polynucleotide
atgagcgtgcccacccaagtgctgggcctgctgctgctgtggctgaccgacgccaggtgcgacatccagatgacccagagccctagcagcctgagcgccagcgtgggagacagggtgaccatcacctgcagggccagccaggacatcagcaactacctgaactggtaccagcagaagcccggcaaggcccccaagctgctgatctactacaccagcaggctgcacagcggagtgcccagcagatttagcggcagcggcagcggcacagactacaccctgaccatcagctccctgcagcccgaggactttgccacctactactgccagcagggcgataccctgcccccttggacatttggcggcggcaccaaggtggagatcaagcgtacggtggctgccccctccgtgttcatcttcccccccagcgatgagcagctgaagagcggcacagccagcgtggtgtgcctgctgaacaacttctaccccagggaggccaaggtgcagtggaaggtggacaacgccctgcagagcggcaacagccaggagtccgtgaccgagcaggacagcaaggacagcacctacagcctgagcagcacactgaccctgagcaaggccgactacgagaagcacaaggtgtacgcctgcgaggtgacccatcagggcctgagcagccccgtgaccaagagcttcaacaggggcgagtgctga

SEQ ID NO: 259 - protein, 215 aa, Artificial Sequence
  Description of Artificial Sequence: Synthetic polypeptide
DIQMTQSPSSLSASVGDRVTITCRASQDISNYLNWYQQKPGKAPKLLIYYTSRLHSGVPSRFSGSGSGTDYTLTISSLQPEDFATYYCQQGDTLPPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 260 - DNA, 708 bp, Artificial Sequence
  Description of Artificial Sequence: Synthetic polynucleotide
atgagcgtgcccacccaagtgctgggcctgctgctgctgtggctgaccgacgccaggtgcgacatccagatgacccagagccctagcagcctgagcgccagcgtgggagacagggtgaccatcacctgcagggccagccaggacatcagcaactacctgaactggtttcagcagaagcccggcaaggcccccaagagcctgatctactacaccagcaggctgcacagcggagtgcccagcagatttagcggcagcggcagcggcacagactacaccctgaccatcagctccctgcagcccgaggactttgccacctactactgccagcagggcgataccctgcccccttggacatttggcggcggcaccaaggtggagatcaagcgtacggtggctgccccctccgtgttcatcttcccccccagcgatgagcagctgaagagcggcacagccagcgtggtgtgcctgctgaacaacttctaccccagggaggccaaggtgcagtggaaggtggacaacgccctgcagagcggcaacagccaggagtccgtgaccgagcaggacagcaaggacagcacctacagcctgagcagcacactgaccctgagcaaggccgactacgagaagcacaaggtgtacgcctgcgaggtgacccatcagggcctgagcagccccgtgaccaagagcttcaacaggggcgagtgctga

SEQ ID NO: 261 - protein, 215 aa, Artificial Sequence
  Description of Artificial Sequence: Synthetic polypeptide
DIQMTQSPSSLSASVGDRVTITCRASQDISNYLNWFQQKPGKAPKSLIYYTSRLHSGVPSRFSGSGSGTDYTLTISSLQPEDFATYYCQQGDTLPPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 262 - DNA, 708 bp, Artificial Sequence; identical to SEQ ID NO: 240
  Description of Artificial Sequence: Synthetic polynucleotide

SEQ ID NO: 263 - protein, 215 aa, Artificial Sequence; identical to SEQ ID NO: 241
  Description of Artificial Sequence: Synthetic polypeptide

SEQ ID NO: 264 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactactatatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaacagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 265 - protein, 450 aa, Artificial Sequence
  Description of Artificial Sequence: Synthetic polypeptide
QVQLVQSGAEVKKPGASVKVSCKASGYTLTDYYMHWVRQAPGQGLEWMGAIDISDSYTSYAQKFQGRVTMTVDTSTSTVYMELSSLRSEDTAVYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 266 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactaccagatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaacagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 267 - protein, 450 aa, Artificial Sequence
  Description of Artificial Sequence: Synthetic polypeptide
QVQLVQSGAEVKKPGASVKVSCKASGYTLTDYQMHWVRQAPGQGLEWMGAIDISDSYTSYAQKFQGRVTMTVDTSTSTVYMELSSLRSEDTAVYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 268 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacttcatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaacagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 269 - protein, 450 aa, Artificial Sequence
  Description of Artificial Sequence: Synthetic polypeptide
QVQLVQSGAEVKKPGASVKVSCKASGYTLTDYFMHWVRQAPGQGLEWMGAIDISDSYTSYAQKFQGRVTMTVDTSTSTVYMELSSLRSEDTAVYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 270 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacctgatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaacagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 271 - protein, 450 aa, Artificial Sequence
  Description of Artificial Sequence: Synthetic polypeptide
QVQLVQSGAEVKKPGASVKVSCKASGYTLTDYLMHWVRQAPGQGLEWMGAIDISDSYTSYAQKFQGRVTMTVDTSTSTVYMELSSLRSEDTAVYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 272 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacatcatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaacagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 273 - protein, 450 aa, Artificial Sequence
  Description of Artificial Sequence: Synthetic polypeptide
QVQLVQSGAEVKKPGASVKVSCKASGYTLTDYIMHWVRQAPGQGLEWMGAIDISDSYTSYAQKFQGRVTMTVDTSTSTVYMELSSLRSEDTAVYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 274 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacgtgatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaacagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 275 - protein, 450 aa, Artificial Sequence
  Description of Artificial Sequence: Synthetic polypeptide
QVQLVQSGAEVKKPGASVKVSCKASGYTLTDYVMHWVRQAPGQGLEWMGAIDISDSYTSYAQKFQGRVTMTVDTSTSTVYMELSSLRSEDTAVYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 276 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactactggatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacgatagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 277 - protein, 450 aa, Artificial Sequence
  Description of Artificial Sequence: Synthetic polypeptide
QVQLVQSGAEVKKPGASVKVSCKASGYTLTDYWMHWVRQAPGQGLEWMGAIDISDSYTSYAQKFQGRVTMTVDTSTSTVYMELSSLRSEDTAVYYCARSPFYDSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 278 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactactggatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctactccagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 279 - protein, 450 aa, Artificial Sequence
  Description of Artificial Sequence: Synthetic polypeptide
QVQLVQSGAEVKKPGASVKVSCKASGYTLTDYWMHWVRQAPGQGLEWMGAIDISDSYTSYAQKFQGRVTMTVDTSTSTVYMELSSLRSEDTAVYYCARSPFYSSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 280 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactactggatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctactttagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 281 - protein, 450 aa, Artificial Sequence
  Description of Artificial Sequence: Synthetic polypeptide
QVQLVQSGAEVKKPGASVKVSCKASGYTLTDYWMHWVRQAPGQGLEWMGAIDISDSYTSYAQKFQGRVTMTVDTSTSTVYMELSSLRSEDTAVYYCARSPFYFSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 282 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactactggatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacgaaagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 283 - protein, 450 aa, Artificial Sequence
  Description of Artificial Sequence: Synthetic polypeptide
QVQLVQSGAEVKKPGASVKVSCKASGYTLTDYWMHWVRQAPGQGLEWMGAIDISDSYTSYAQKFQGRVTMTVDTSTSTVYMELSSLRSEDTAVYYCARSPFYESRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 284 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactactggatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctaccaaagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 285 - protein, 450 aa, Artificial Sequence
  Description of Artificial Sequence: Synthetic polypeptide
QVQLVQSGAEVKKPGASVKVSCKASGYTLTDYWMHWVRQAPGQGLEWMGAIDISDSYTSYAQKFQGRVTMTVDTSTSTVYMELSSLRSEDTAVYYCARSPFYQSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 286 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactactggatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaggagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 287 - protein, 450 aa, Artificial Sequence
  Description of Artificial Sequence: Synthetic polypeptide
QVQLVQSGAEVKKPGASVKVSCKASGYTLTDYWMHWVRQAPGQGLEWMGAIDISDSYTSYAQKFQGRVTMTVDTSTSTVYMELSSLRSEDTAVYYCARSPFYRSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 288 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactactatatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacgatagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 289 - protein, 450 aa, Artificial Sequence
  Description of Artificial Sequence: Synthetic polypeptide
QVQLVQSGAEVKKPGASVKVSCKASGYTLTDYYMHWVRQAPGQGLEWMGAIDISDSYTSYAQKFQGRVTMTVDTSTSTVYMELSSLRSEDTAVYYCARSPFYDSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 290 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactactatatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctactccagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 291 - protein, 450 aa, Artificial Sequence
  Description of Artificial Sequence: Synthetic polypeptide
QVQLVQSGAEVKKPGASVKVSCKASGYTLTDYYMHWVRQAPGQGLEWMGAIDISDSYTSYAQKFQGRVTMTVDTSTSTVYMELSSLRSEDTAVYYCARSPFYSSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 292 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactactatatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctactttagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 293 - protein, 450 aa, Artificial Sequence
  Description of Artificial Sequence: Synthetic polypeptide
QVQLVQSGAEVKKPGASVKVSCKASGYTLTDYYMHWVRQAPGQGLEWMGAIDISDSYTSYAQKFQGRVTMTVDTSTSTVYMELSSLRSEDTAVYYCARSPFYFSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 294 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactactatatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacgaaagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 295 - protein, 450 aa, Artificial Sequence
  Description of Artificial Sequence: Synthetic polypeptide
QVQLVQSGAEVKKPGASVKVSCKASGYTLTDYYMHWVRQAPGQGLEWMGAIDISDSYTSYAQKFQGRVTMTVDTSTSTVYMELSSLRSEDTAVYYCARSPFYESRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 296 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactactatatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctaccaaagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 297 - protein, 450 aa, Artificial Sequence
  Description of Artificial Sequence: Synthetic polypeptide
QVQLVQSGAEVKKPGASVKVSCKASGYTLTDYYMHWVRQAPGQGLEWMGAIDISDSYTSYAQKFQGRVTMTVDTSTSTVYMELSSLRSEDTAVYYCARSPFYQSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 298 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactactatatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaggagcaggggcggaaactacttcgactactggggccagggcacaaccgtgaccgtgtctagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 299 - protein, 450 aa, Artificial Sequence
  Description of Artificial Sequence: Synthetic polypeptide
QVQLVQSGAEVKKPGASVKVSCKASGYTLTDYYMHWVRQAPGQGLEWMGAIDISDSYTSYAQKFQGRVTMTVDTSTSTVYMELSSLRSEDTAVYYCARSPFYRSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 300 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactaccagatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacgatagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 301 - protein, 450 aa, Artificial Sequence
  Description of Artificial Sequence: Synthetic polypeptide
QVQLVQSGAEVKKPGASVKVSCKASGYTLTDYQMHWVRQAPGQGLEWMGAIDISDSYTSYAQKFQGRVTMTVDTSTSTVYMELSSLRSEDTAVYYCARSPFYDSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 302 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactaccagatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctactccagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 303 - protein, 450 aa, Artificial Sequence
  Description of Artificial Sequence: Synthetic polypeptide
QVQLVQSGAEVKKPGASVKVSCKASGYTLTDYQMHWVRQAPGQGLEWMGAIDISDSYTSYAQKFQGRVTMTVDTSTSTVYMELSSLRSEDTAVYYCARSPFYSSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 304 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactaccagatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacgaaagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 305 - protein, 450 aa, Artificial Sequence
  Description of Artificial Sequence: Synthetic polypeptide
QVQLVQSGAEVKKPGASVKVSCKASGYTLTDYQMHWVRQAPGQGLEWMGAIDISDSYTSYAQKFQGRVTMTVDTSTSTVYMELSSLRSEDTAVYYCARSPFYESRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 306 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactaccagatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctaccaaagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 307 - protein, 450 aa, Artificial Sequence
  Description of Artificial Sequence: Synthetic polypeptide
QVQLVQSGAEVKKPGASVKVSCKASGYTLTDYQMHWVRQAPGQGLEWMGAIDISDSYTSYAQKFQGRVTMTVDTSTSTVYMELSSLRSEDTAVYYCARSPFYQSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 308 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactaccagatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaggagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 309 - protein, 450 aa, Artificial Sequence
  Description of Artificial Sequence: Synthetic polypeptide
QVQLVQSGAEVKKPGASVKVSCKASGYTLTDYQMHWVRQAPGQGLEWMGAIDISDSYTSYAQKFQGRVTMTVDTSTSTVYMELSSLRSEDTAVYYCARSPFYRSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 310 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacttcatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacgatagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 311 - protein, 450 aa, Artificial Sequence
  Description of Artificial Sequence: Synthetic polypeptide
QVQLVQSGAEVKKPGASVKVSCKASGYTLTDYFMHWVRQAPGQGLEWMGAIDISDSYTSYAQKFQGRVTMTVDTSTSTVYMELSSLRSEDTAVYYCARSPFYDSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 312 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacttcatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctactccagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 313 - protein, 450 aa, Artificial Sequence
  Description of Artificial Sequence: Synthetic polypeptide
QVQLVQSGAEVKKPGASVKVSCKASGYTLTDYFMHWVRQAPGQGLEWMGAIDISDSYTSYAQKFQGRVTMTVDTSTSTVYMELSSLRSEDTAVYYCARSPFYSSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 314 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacttcatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctactttagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 315 - protein, 450 aa, Artificial Sequence
  Description of Artificial Sequence: Synthetic polypeptide
QVQLVQSGAEVKKPGASVKVSCKASGYTLTDYFMHWVRQAPGQGLEWMGAIDISDSYTSYAQKFQGRVTMTVDTSTSTVYMELSSLRSEDTAVYYCARSPFYFSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 316 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacttcatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacgaaagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 317 - protein, 450 aa, Artificial Sequence
  Description of Artificial Sequence: Synthetic polypeptide
QVQLVQSGAEVKKPGASVKVSCKASGYTLTDYFMHWVRQAPGQGLEWMGAIDISDSYTSYAQKFQGRVTMTVDTSTSTVYMELSSLRSEDTAVYYCARSPFYESRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 318 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacttcatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctaccaaagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 319 - protein, 450 aa, Artificial Sequence
  Description of Artificial Sequence: Synthetic polypeptide
QVQLVQSGAEVKKPGASVKVSCKASGYTLTDYFMHWVRQAPGQGLEWMGAIDISDSYTSYAQKFQGRVTMTVDTSTSTVYMELSSLRSEDTAVYYCARSPFYQSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 320 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacttcatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaggagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 321 - protein, 450 aa, Artificial Sequence
  Description of Artificial Sequence: Synthetic polypeptide
QVQLVQSGAEVKKPGASVKVSCKASGYTLTDYFMHWVRQAPGQGLEWMGAIDISDSYTSYAQKFQGRVTMTVDTSTSTVYMELSSLRSEDTAVYYCARSPFYRSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 322 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacctgatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacgatagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 323 - protein, 450 aa, Artificial Sequence
  Description of Artificial Sequence: Synthetic polypeptide
QVQLVQSGAEVKKPGASVKVSCKASGYTLTDYLMHWVRQAPGQGLEWMGAIDISDSYTSYAQKFQGRVTMTVDTSTSTVYMELSSLRSEDTAVYYCARSPFYDSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 324 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacctgatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctactccagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 325 - protein, 450 aa, Artificial Sequence
  Description of Artificial Sequence: Synthetic polypeptide
QVQLVQSGAEVKKPGASVKVSCKASGYTLTDYLMHWVRQAPGQGLEWMGAIDISDSYTSYAQKFQGRVTMTVDTSTSTVYMELSSLRSEDTAVYYCARSPFYSSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 326 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacctgatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctactttagcaggggcggaaactacttcgactactggggccagggcacaaccgtgaccgtgtctagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 327 - protein, 450 aa, Artificial Sequence
  Description of Artificial Sequence: Synthetic polypeptide
QVQLVQSGAEVKKPGASVKVSCKASGYTLTDYLMHWVRQAPGQGLEWMGAIDISDSYTSYAQKFQGRVTMTVDTSTSTVYMELSSLRSEDTAVYYCARSPFYFSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 328 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacctgatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacgaaagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 329 - protein, 450 aa, Artificial Sequence
  Description of Artificial Sequence: Synthetic polypeptide
QVQLVQSGAEVKKPGASVKVSCKASGYTLTDYLMHWVRQAPGQGLEWMGAIDISDSYTSYAQKFQGRVTMTVDTSTSTVYMELSSLRSEDTAVYYCARSPFYESRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 330 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacctgatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctaccaaagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 331 - protein, 450 aa, Artificial Sequence
  Description of Artificial Sequence: Synthetic polypeptide
QVQLVQSGAEVKKPGASVKVSCKASGYTLTDYLMHWVRQAPGQGLEWMGAIDISDSYTSYAQKFQGRVTMTVDTSTSTVYMELSSLRSEDTAVYYCARSPFYQSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 332 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacctgatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaggagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 333 - protein, 450 aa, Artificial Sequence
  Description of Artificial Sequence: Synthetic polypeptide
QVQLVQSGAEVKKPGASVKVSCKASGYTLTDYLMHWVRQAPGQGLEWMGAIDISDSYTSYAQKFQGRVTMTVDTSTSTVYMELSSLRSEDTAVYYCARSPFYRSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 334 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacatcatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacgatagcaggggcggaaactacttcgactactggggccagggcacaaccgtgaccgtgtctagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 335 - protein, 450 aa, Artificial Sequence
  Description of Artificial Sequence: Synthetic polypeptide
QVQLVQSGAEVKKPGASVKVSCKASGYTLTDYIMHWVRQAPGQGLEWMGAIDISDSYTSYAQKFQGRVTMTVDTSTSTVYMELSSLRSEDTAVYYCARSPFYDSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 336 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacatcatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctactccagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 337 - protein, 469 aa, Artificial Sequence
  Description of Artificial Sequence: Synthetic polypeptide
MEWSWVFLFFLSVTTGVHSQVQLVQSGAEVKKPGASVKVSCKASGYTLTDYIMHWVRQAPGQGLEWMGAIDISDSYTSYAQKFQGRVTMTVDTSTSTVYMELSSLRSEDTAVYYCARSPFYSSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 338 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacgtgatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacgaaagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 339 - protein, 450 aa, Artificial Sequence
  Description of Artificial Sequence: Synthetic polypeptide
QVQLVQSGAEVKKPGASVKVSCKASGYTLTDYVMHWVRQAPGQGLEWMGAIDISDSYTSYAQKFQGRVTMTVDTSTSTVYMELSSLRSEDTAVYYCARSPFYESRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 340 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacgtgatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctaccaaagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 341 - protein, 450 aa, Artificial Sequence
  Description of Artificial Sequence: Synthetic polypeptide
QVQLVQSGAEVKKPGASVKVSCKASGYTLTDYVMHWVRQAPGQGLEWMGAIDISDSYTSYAQKFQGRVTMTVDTSTSTVYMELSSLRSEDTAVYYCARSPFYQSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 342 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacgtgatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaggagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 343 - protein, 450 aa, Artificial Sequence
  Description of Artificial Sequence: Synthetic polypeptide
QVQLVQSGAEVKKPGASVKVSCKASGYTLTDYVMHWVRQAPGQGLEWMGAIDISDSYTSYAQKFQGRVTMTVDTSTSTVYMELSSLRSEDTAVYYCARSPFYRSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 344 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacgctatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaacagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 345 - protein, 450 aa, Artificial Sequence
  Description of Artificial Sequence: Synthetic polypeptide
QVQLVQSGAEVKKPGASVKVSCKASGYTLTDYAMHWVRQAPGQGLEWMGAIDISDSYTSYAQKFQGRVTMTVDTSTSTVYMELSSLRSEDTAVYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 346 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactactccatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaacagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 347 - protein, 450 aa, Artificial Sequence
  Description of Artificial Sequence: Synthetic polypeptide
QVQLVQSGAEVKKPGASVKVSCKASGYTLTDYSMHWVRQAPGQGLEWMGAIDISDSYTSYAQKFQGRVTMTVDTSTSTVYMELSSLRSEDTAVYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 348 - DNA, 1410 bp, Artificial Sequence
  Description of Artificial Sequence: Synthetic polynucleotide
atggagtggagctgggtgttcctgtttttcctgtccgtgaccaccggcgtgcactcccaggtgcaactggtgcagtccggcgccgaagtgaagaagcctggcgcctccgtgaaggtgagctgcaaggccagcggctataccctgaccgactacgacatgcactgggtgcggcaggctcctggacagggcctggaatggatgggcgctattgacatcagcgatagctacaccagctacgcccagaagttccagggaagggtgacaatgaccgtggataccagcacctccaccgtgtacatggagctgtcctccctgcggagcgaggataccgccgtgtactactgtgccaggagccccttctacaacagcaggggcggaaactacttcgactactggggccagggcacaaccgtgaccgtgtcgagcgcctccaccaagggaccttccgtgttccccctggctccctgctccaggagcacatccgagagcacagctgccctgggctgtctggtgaaggattatttccctgagcccgtgaccgtgtcctggaacagcggcgccctcacctccggagtgcacacctttcctgccgtgctgcagagctccggcctgtacagcctgtcctccgtggtgacagtgcctagcagcagcctcggaaccaagacctacacatgcaacgtcgaccataagcccagcaacaccaaggtggacaagcgggtggagagcaaatacggccccccttgtcccccctgtcctgcccctgagttcctgggaggaccctccgtgttcctgttcccccccaagcctaaggatacactgatgatctcccggacccccgaggtgacatgcgtggtggtcgatgtgtcccaggaggaccccgaggtgcagtttaactggtatgtggacggcgtggaagtgcacaatgctaagacaaagcctcgggaggagcagttcaacagcacataccgggtggtgagcgtgctcacagtgctgcaccaggactggctcaacggcaaggagtataagtgcaaggtctccaacaagggcctccccagcagcatcgagaagaccatcagcaaggccaagggccaacccagggagcctcaggtgtacaccctccctcctagccaggaggagatgaccaagaaccaagtgtccctgacctgtctcgtgaagggattttaccccagcgacatcgccgtcgaatgggaatccaacggacagcccgagaacaactacaaaaccacccctcccgtgctcgatagcgacggcagctttttcctgtattccaggctgaccgtggacaagtcccggtggcaagaaggcaacgtgttcagctgtagcgtgatgcacgaggccctgcataaccactacacccaaaagagcctctccctgtccctgggcaagtga

SEQ ID NO: 349 - protein, 450 aa, Artificial Sequence
  Description of Artificial Sequence: Synthetic polypeptide
QVQLVQSGAEVKKPGASVKVSCKASGYTLTDYDMHWVRQAPGQGLEWMGAIDISDSYTSYAQKFQGRVTMTVDTSTSTVYMELSSLRSEDTAVYYCARSPFYNSRGGNYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 350 - DNA, 708 bp, Artificial Sequence
  Description of Artificial Sequence: Synthetic polynucleotide
atgtccgtgcccacccaagtgctgggcctgctgctgctgtggctgaccgacgccaggtgcgacatccagatgacccagagccctagcagcctgagcgccagcgtgggagacagggtgaccatcacctgtagggccagccaggacatcagcaactacctgaactggtaccagcagaagcccggcaaggcccccaagctgctgatctactacaccagcaggctgcacagcggcgtgcccagcagattcagcggaagcggcagcggcaccgacttcaccttcaccatctccagcctgcagcccgaggacatcgccacctactactgtcagcagggcgacaccctgcccccttggacattcggaggcggcaccaaggtggagatcaagcgtacggtggctgccccctccgtgttcatcttcccccccagcgatgagcagctgaagagcggcacagccagcgtggtgtgcctgctgaacaacttctaccccagggaggccaaggtgcagtggaaggtggacaacgccctgcagagcggcaacagccaggagtccgtgaccgagcaggacagcaaggacagcacctacagcctgagcagcacactgaccctgagcaaggccgactacgagaagcacaaggtgtacgcctgcgaggtgacccatcagggcctgagcagccccgtgaccaagagcttcaacaggggcgagtgctga

SEQ ID NO: 351 - protein, 215 aa, Artificial Sequence
  Description of Artificial Sequence: Synthetic polypeptide
DIQMTQSPSSLSASVGDRVTITCRASQDISNYLNWYQQKPGKAPKLLIYYTSRLHSGVPSRFSGSGSGTDFTFTISSLQPEDIATYYCQQGDTLPPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 352 - DNA, 1398 bp, Artificial Sequence
  Description of Artificial Sequence: Synthetic polynucleotide
atggagtggtcctgggtgttcctgttcttcctgagcgtgaccaccggcgtgcactcccaggtgcagctggtgcagagcggagccgaggtgaagaagcctggcgccagcgtgaaggtgtcctgcaaggccagcggcagctccttcaccgactactacatccactgggtgagacaggcccctggccagggactggagtggatgggcaggatttaccccggcagcggcaatagcaactacgcccagaagttccagggcagggtgaccagcaccagggacaccagcatcagcaccgcctacatggagctgagcaggctgaggagcgacgacaccgtcgtgtactactgcgccagggaggccgactacgacgatgccctggactactggggacagggaaccaccgtgaccgtgtcgagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 353 - protein, 446 aa, Artificial Sequence
  Description of Artificial Sequence: Synthetic polypeptide
QVQLVQSGAEVKKPGASVKVSCKASGSSFTDYYIHWVRQAPGQGLEWMGRIYPGSGNSNYAQKFQGRVTSTRDTSISTAYMELSRLRSDDTVVYYCAREADYDDALDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 354 - DNA, 1407 bp, Artificial Sequence
  Description of Artificial Sequence: Synthetic polynucleotide
atggagtggagctgggtgttcctcttcttcctgagcgtcaccaccggcgtccactccgaagtgcagctggtgcagagcggcgccgaggtgaagaagcctggcgagagcctgaaaatcagctgcaagggaagcggctccagcttcaccgactactacatcaactgggtgaggcagatgcctggcaagggcctcgagtggatgggctggatctaccccggcagcggcaatacaatctacagccccagcttccagggccaagtgacaatcagcgtggataagtccatctccaccgcctacctgcaatggagctccctcaaggccagcgacaccgccatgtattattgcgctagggaggccgactacgacgatgccctggactactggggccaaggaaccaccgtcacagtgtcgtccgccagcaccaagggaccctccgtcttccccctggctcctagcagcaagagcacctccggcggaacagctgccctgggatgtctcgtgaaggattactttcccgagcctgtcaccgtgtcctggaacagcggagccctgaccagcggcgtgcatacattccccgccgtgctgcagagcagcggactgtactccctgtcctccgtggtgacagtgccttcctccagcctgggcacccagacctatatttgcaacgtgaaccacaagcccagcaacaccaaggtggacaagaaggtggagcccaagtcctgcgacaaaacacacacctgccctccctgtcctgctcccgaactcctcggaggcccttccgtgttcctgttcccccccaagcccaaggacaccctgatgattagcagaacccccgaagtgacctgtgtggtggtcgatgtctcccatgaggaccccgaggtcaaattcaactggtacgtggacggcgtggaggtccacaatgccaaaaccaagcccagggaggagcagtataacagcacctacagggtggtgagcgtgctgaccgtgctgcaccaggactggctgaacggcaaggagtacaagtgcaaggtgtccaacaaggccctgcctgcccccattgagaagaccatctccaaggccaagggccagcctagggagccccaggtgtacaccctccctccctccagggacgagctgaccaagaaccaggtctccctgacctgcctggtgaagggcttttatcccagcgacatcgccgtggagtgggaaagcaacggccagcccgagaacaattacaagaccaccccccccgtgctggacagcgatggcagcttcttcctgtacagcaagctgacagtggacaagtccaggtggcaacagggcaatgtcttctcctgcagcgtgatgcacgaggccctgcacaaccactatacccagaaatccctcagcctgtcccctggaaagtga

SEQ ID NO: 355 - protein, 449 aa, Artificial Sequence
  Description of Artificial Sequence: Synthetic polypeptide
EVQLVQSGAEVKKPGESLKISCKGSGSSFTDYYINWVRQMPGKGLEWMGWIYPGSGNTIYSPSFQGQVTISVDKSISTAYLQWSSLKASDTAMYYCAREADYDDALDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 356 - DNA, 1431 bp, Artificial Sequence; identical to SEQ ID NO: 250
  Description of Artificial Sequence: Synthetic polynucleotide

SEQ ID NO: 357 - protein, 457 aa, Artificial Sequence; identical to SEQ ID NO: 251
  Description of Artificial Sequence: Synthetic polypeptide

SEQ ID NO: 358 - DNA, 1398 bp, Artificial Sequence; identical to SEQ ID NO: 252
  Description of Artificial Sequence: Synthetic polynucleotide

SEQ ID NO: 359 - protein, 446 aa, Artificial Sequence; identical to SEQ ID NO: 253
  Description of Artificial Sequence: Synthetic polypeptide

SEQ ID NO: 360 - DNA, 1398 bp, Artificial Sequence
  Description of Artificial Sequence: Synthetic polynucleotide
atggagtggagctgggtgttcctgttcttcctgagcgtgaccaccggcgtgcactcccaggtgcaactggtgcagagcggcgccgaggtgaagaaacccggagccagcgtgaaggtgagctgcaaggccagcggcagcagcttcaccgactactacatcaactgggtgagacaggcccctggacagggcctggagtggatgggctggatctaccccggcagcggcaacaccatctacgcccagaagtttcagggcagggtgaccatgaccgtggacaccagcaccagcaccgtgtacatggagctgagcagcctgagaagcgaggacaccgccgtgtactactgcgccagagaggccgattacgacgacgccctggactactggggccagggaaccaccgtgaccgtgtcgagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 361 - protein, 446 aa, Artificial Sequence
  Description of Artificial Sequence: Synthetic polypeptide
QVQLVQSGAEVKKPGASVKVSCKASGSSFTDYYINWVRQAPGQGLEWMGWIYPGSGNTIYAQKFQGRVTMTVDTSTSTVYMELSSLRSEDTAVYYCAREADYDDALDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 362 - DNA, 1398 bp, Artificial Sequence
  Description of Artificial Sequence: Synthetic polynucleotide
atggagtggagctgggtgttcctgttcttcctcagcgtgaccaccggcgtgcacagccaggtgcagctggtgcagagcggcgccgaagtgaaaaagcccggcgccagcgtcaaggtgagctgcaaggccagcggcagcagcttcaccgactactacatcaactgggtgaggcaggccaccggacagggactggagtggatgggctggatctaccccggcagcggcaacaccatctacgcccagaagttccagggcagggtgaccatgaccgtggacaccagcatcagcaccgcctacatggagctgagcagcctgaggtccgaggacaccgccgtgtactactgcgccagggaagccgactacgacgacgccctggactactggggacagggcaccaccgtgaccgtgtcgagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 363 - protein, 446 aa, Artificial Sequence
  Description of Artificial Sequence: Synthetic polypeptide
QVQLVQSGAEVKKPGASVKVSCKASGSSFTDYYINWVRQATGQGLEWMGWIYPGSGNTIYAQKFQGRVTMTVDTSISTAYMELSSLRSEDTAVYYCAREADYDDALDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 364 - DNA, 1398 bp, Artificial Sequence
  Description of Artificial Sequence: Synthetic polynucleotide
atggagtggagctgggtgttcctgttcttcctgagcgtgaccacaggcgtgcacagccaggtgcagctggtgcaaagcggcgccgaggtgaagaaacctggcgccagcgtgaaagtgagctgcaaggcctccggctcctccttcaccgactactacatcaactgggtgaggcaggcccctggccagagactcgagtggatgggctggatctaccccggcagcggcaacaccatctactcccagaagttccagggaagggtgaccatcaccgtggacaccagcgccagcaccgcctacatggagctgagcagcctgagaagcgaggataccgccgtgtactactgcgccagggaggccgactatgacgacgccctggactactggggacagggcaccaccgtgaccgtgtcgagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 365 - protein, 446 aa, Artificial Sequence
  Description of Artificial Sequence: Synthetic polypeptide
QVQLVQSGAEVKKPGASVKVSCKASGSSFTDYYINWVRQAPGQRLEWMGWIYPGSGNTIYSQKFQGRVTITVDTSASTAYMELSSLRSEDTAVYYCAREADYDDALDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 366 - DNA, 1398 bp, Artificial Sequence
  Description of Artificial Sequence: Synthetic polynucleotide
atggagtggtcctgggtgttcctgttcttcctgagcgtgaccaccggcgtgcacagccagatgcagctggtgcagagcggcgccgaggtgaagaagaccggcagctccgtgaaggtgagctgcaaggccagcggcagcagcttcaccgactactacatcaactgggtgagacaggcccctggacaggccctggagtggatgggctggatctaccccggcagcggcaacaccatctacgcccagaagttccaggacagggtgaccattaccgtggacaggagcagctccaccgcctacatggagctgagcagcctgaggagcgaggacaccgccatgtactactgcgccagggaggccgactacgacgacgctctggactactggggccagggcacaaccgtgaccgtgtcgagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 367 - protein, 446 aa, Artificial Sequence
  Description of Artificial Sequence: Synthetic polypeptide
QMQLVQSGAEVKKTGSSVKVSCKASGSSFTDYYINWVRQAPGQALEWMGWIYPGSGNTIYAQKFQDRVTITVDRSSSTAYMELSSLRSEDTAMYYCAREADYDDALDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 368 - DNA, 720 bp, Artificial Sequence
  Description of Artificial Sequence: Synthetic polynucleotide
atgagcgtgcccacccaggtgctgggactgctgctgctgtggctgaccgacgccaggtgcgacatcgtgatgacccagacacccctgagcctgagcgtgacacctggccagcctgccagcatcagctgcaggagcagcaagagcctgctgcacagcgacggcaacacctacctgtactggtacctgcagaagcccggccagcctcctcagctgctgatctacaggatgagcaacctggcctccggcgtgcctgacaggttcagcggaagcggcagcggcaccgacttcaccctgaagatcagcagagtggaggccgaggacgtcggcgtgtactactgcatgcagcacctggagtaccccttcaccttcggcggcggcaccaaggtggagatcaagcgtacggtggctgccccctccgtgttcatcttcccccccagcgatgagcagctgaagagcggcacagccagcgtggtgtgcctgctgaacaacttctaccccagggaggccaaggtgcagtggaaggtggacaacgccctgcagagcggcaacagccaggagtccgtgaccgagcaggacagcaaggacagcacctacagcctgagcagcacactgaccctgagcaaggccgactacgagaagcacaaggtgtacgcctgcgaggtgacccatcagggcctgagcagccccgtgaccaagagcttcaacaggggcgagtgctga

SEQ ID NO: 369 - protein, 219 aa, Artificial Sequence
  Description of Artificial Sequence: Synthetic polypeptide
DIVMTQTPLSLSVTPGQPASISCRSSKSLLHSDGNTYLYWYLQKPGQPPQLLIYRMSNLASGVPDRFSGSGSGTDFTLKISRVEAEDVGVYYCMQHLEYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 370 - DNA, 708 bp, Artificial Sequence
  Description of Artificial Sequence: Synthetic polynucleotide
atgtccgtgcccacccaggtgctgggactgctgctgctgtggctgaccgacgccaggtgcgacatccagatgacccagagccctagcagcctgagcgctagcgtgggcgacagggtgaccatcacctgtagggccagccagagcatcggcacctccatccactggtaccagcagaagcccggcaaggcccccaagctgctgatctactacgcctccgagagcatcagcggcgtgcctagcagatttagcggcagcggcagcggcaccgactttaccctgaccatctccagcctgcagcccgaggacttcgccacctactactgccagcagagcaacagctggcccacctacaccttcggcggcggaaccaaggtggagattaagcgtacggtggctgccccctccgtgttcatcttcccccccagcgatgagcagctgaagagcggcacagccagcgtggtgtgcctgctgaacaacttctaccccagggaggccaaggtgcagtggaaggtggacaacgccctgcagagcggcaacagccaggagtccgtgaccgagcaggacagcaaggacagcacctacagcctgagcagcacactgaccctgagcaaggccgactacgagaagcacaaggtgtacgcctgcgaggtgacccatcagggcctgagcagccccgtgaccaagagcttcaacaggggcgagtgctga

SEQ ID NO: 371 - protein, 215 aa, Artificial Sequence
  Description of Artificial Sequence: Synthetic polypeptide
DIQMTQSPSSLSASVGDRVTITCRASQSIGTSIHWYQQKPGKAPKLLIYYASESISGVPSRFSGSGSGTDFTLTISSLQPEDFATYYCQQSNSWPTYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 372 - DNA, 702 bp, Artificial Sequence
  Description of Artificial Sequence: Synthetic polynucleotide
atgtccgtgcccacccaggtgctgggactgctgctgctgtggctgaccgacgccaggtgcgacatccagatgacccagagccctagcagcgtcagcgtgggcgacagggtgaccatcacctgtagggccagccagagcatcggcacctccatccactggtaccagcagaagcccggcaaggcccccaagctgctgatctactacgcctccgagagcatcagcggcgtgcctagcagatttagcggcagcggcagcggcaccgactttaccctgaccatctccagcctgcagcccgaggacttcgccacctactactgccagcagagcaacagctggcccacctacaccttcggcggcggaaccaaggtggagattaagcgtacggtggctgccccctccgtgttcatcttcccccccagcgatgagcagctgaagagcggcacagccagcgtggtgtgcctgctgaacaacttctaccccagggaggccaaggtgcagtggaaggtggacaacgccctgcagagcggcaacagccaggagtccgtgaccgagcaggacagcaaggacagcacctacagcctgagcagcacactgaccctgagcaaggccgactacgagaagcacaaggtgtacgcctgcgaggtgacccatcagggcctgagcagccccgtgaccaagagcttcaacaggggcgagtgctga

SEQ ID NO: 373 - protein, 215 aa, Artificial Sequence
  Description of Artificial Sequence: Synthetic polypeptide
DIQMTQSPSSVSASVGDRVTITCRASQSIGTSIHWYQQKPGKAPKLLIYYASESISGVPSRFSGSGSGTDFTLTISSLQPEDFATYYCQQSNSWPTYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 374 - DNA, 708 bp, Artificial Sequence
  Description of Artificial Sequence: Synthetic polynucleotide
atgtccgtgcccacccaggtgctgggactgctgctgctgtggctgaccgacgccaggtgcgacatccagctgacccagagccctagctttctgagcgctagcgtgggcgacagggtgaccatcacctgtagggccagccagagcatcggcacctccatccactggtaccagcagaagcccggcaaggcccccaagctgctgatctactacgcctccgagagcatcagcggcgtgcctagcagatttagcggcagcggcagcggcaccgaatttaccctgaccatctccagcctgcagcccgaggacttcgccacctactactgccagcagagcaacagctggcccacctacaccttcggcggcggaaccaaggtggagattaagcgtacggtggctgccccctccgtgttcatcttcccccccagcgatgagcagctgaagagcggcacagccagcgtggtgtgcctgctgaacaacttctaccccagggaggccaaggtgcagtggaaggtggacaacgccctgcagagcggcaacagccaggagtccgtgaccgagcaggacagcaaggacagcacctacagcctgagcagcacactgaccctgagcaaggccgactacgagaagcacaaggtgtacgcctgcgaggtgacccatcagggcctgagcagccccgtgaccaagagcttcaacaggggcgagtgctga

SEQ ID NO: 375 - protein, 215 aa, Artificial Sequence
  Description of Artificial Sequence: Synthetic polypeptide
DIQLTQSPSFLSASVGDRVTITCRASQSIGTSIHWYQQKPGKAPKLLIYYASESISGVPSRFSGSGSGTEFTLTISSLQPEDFATYYCQQSNSWPTYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 376 - DNA, 1401 bp, Artificial Sequence
  Description of Artificial Sequence: Synthetic polynucleotide
atggagtggtcctgggtgtttctcttcttcctgtccgtgaccaccggcgtgcacagccaagtgcagctggtccagagcggcgctgaggtgaagaagcccggagccagcgtcaaggtgagctgcaaggccagcggctttaacatcgaggactactacatgcactgggtgagacaggctcctggccagggcctggagtggatgggctggatcgaccccgtgaacggcgacacagaatacgctcagaagttccagggcagggtgaccatgaccgccgataccagcaccagcaccgtctacatggagctgagctccctcagatccgaggacaccgccgtgtactactgcaacttctatgacggatacctctttgccttttggggccagggaaccctggtcaccgtgagctccgccagcaccaagggaccctccgtcttccccctggctcctagcagcaagagcacctccggcggaacagctgccctgggatgtctcgtgaaggattactttcccgagcctgtcaccgtgtcctggaacagcggagccctgaccagcggcgtgcatacattccccgccgtgctgcagagcagcggactgtactccctgtcctccgtggtgacagtgccttcctccagcctgggcacccagacctatatttgcaacgtgaaccacaagcccagcaacaccaaggtggacaagaaggtggagcccaagtcctgcgacaaaacacacacctgccctccctgtcctgctcccgaactcctcggaggcccttccgtgttcctgttcccccccaagcccaaggacaccctgatgattagcagaacccccgaagtgacctgtgtggtggtcgatgtctcccatgaggaccccgaggtcaaattcaactggtacgtggacggcgtggaggtccacaatgccaaaaccaagcccagggaggagcagtataacagcacctacagggtggtgagcgtgctgaccgtgctgcaccaggactggctgaacggcaaggagtacaagtgcaaggtgtccaacaaggccctgcctgcccccattgagaagaccatctccaaggccaagggccagcctagggagccccaggtgtacaccctccctccctccagggacgagctgaccaagaaccaggtctccctgacctgcctggtgaagggcttttatcccagcgacatcgccgtggagtgggaaagcaacggccagcccgagaacaattacaagaccaccccccccgtgctggacagcgatggcagcttcttcctgtacagcaagctgacagtggacaagtccaggtggcaacagggcaatgtcttctcctgcagcgtgatgcacgaggccctgcacaaccactatacccagaaatccctcagcctgtcccctggaaagtga

SEQ ID NO: 377 - protein, 447 aa, Artificial Sequence
  Description of Artificial Sequence: Synthetic polypeptide
QVQLVQSGAEVKKPGASVKVSCKASGFNIEDYYMHWVRQAPGQGLEWMGWIDPVNGDTEYAQKFQGRVTMTADTSTSTVYMELSSLRSEDTAVYYCNFYDGYLFAFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 378 - DNA, 1392 bp, Artificial Sequence
  Description of Artificial Sequence: Synthetic polynucleotide
atggagtggagctgggtgttcctgttcttcctgtccgtgaccaccggcgtgcacagccaggtgcagctggtgcagagcggcgctgaggtgaagaaacccggcgccagcgtgaaggtgagctgcaaggccagcggcttcaacatcgaggactactacatgcactgggtgaggcaggcccctggacagggactggagtggatgggctggatcgaccccgtgaacggcgacaccgagtacgcccagaagttccagggcagggtgaccatgaccgccgacaccagcaccagcaccgtgtacatggagctgagcagcctgaggagcgaggacaccgccgtgtactactgcaacttctacgacggctacctgttcgccttctggggccagggcaccctggtgacagtgagcagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 379 - protein, 444 aa, Artificial Sequence
  Description of Artificial Sequence: Synthetic polypeptide
QVQLVQSGAEVKKPGASVKVSCKASGFNIEDYYMHWVRQAPGQGLEWMGWIDPVNGDTEYAQKFQGRVTSTADTSISTAYMELSRLRSDDTVVYYCARYDGYLFAFWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 380 - DNA, 1392 bp, Artificial Sequence
  Description of Artificial Sequence: Synthetic polynucleotide
atggagtggtcctgggtgttcctgttctttctgagcgtgaccaccggcgtgcactcccaggtgcagctggtgcagagcggagctgaggtgaagaagcccggcgccagcgtgaaggtgagctgcaaggccagcggcttcaacatcgaggactactacatgcactgggtgagacaggctcctggccagggactggagtggatgggctggatcgaccccgtgaacggcgacaccgagtacgcccagaagtttcagggcagggtgaccagcaccgccgataccagcatcagcaccgcctacatggagctgagcaggctgaggagcgatgacaccgtggtgtactactgcgctcgttacgacggctacctgttcgccttctggggccagggcacactggtgaccgtgagcagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 381 - protein, 444 aa, Artificial Sequence; identical to SEQ ID NO: 379
  Description of Artificial Sequence: Synthetic polypeptide

SEQ ID NO: 382 - DNA, 1392 bp, Artificial Sequence
  Description of Artificial Sequence: Synthetic polynucleotide
atggagtggtcctgggtgttcctgttctttctgagcgtgaccaccggcgtgcactcccaggtgcagctggtgcagagcggagctgaggtgaagaagcccggcgccagcgtgaaggtgagctgcaaggccagcggcttcaacatcgaggactactacatgcactgggtgagacaggctcctggccagggactggagtggatgggctggatcgaccccgtgaacggcgacaccgagtacgcccagaagtttcagggcagggtgaccagcaccgccgataccagcatcagcaccgcctacatggagctgagcaggctgaggagcgatgacaccgtggtgtactactgcaacttctacgacggctacctgttcgccttctggggccagggcacactggtgaccgtgagcagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 383 - protein, 444 aa, Artificial Sequence
  Description of Artificial Sequence: Synthetic polypeptide
QVQLVQSGAEVKKPGASVKVSCKASGFNIEDYYMHWVRQAPGQGLEWMGWIDPVNGDTEYAQKFQGRVTSTADTSISTAYMELSRLRSDDTVVYYCNFYDGYLFAFWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 384 - DNA, 1392 bp, Artificial Sequence
  Description of Artificial Sequence: Synthetic polynucleotide
atggagtggagctgggtgttcctgttcttcctgagcgtgaccaccggcgtgcacagccaggtgcagctggtgcagagcggagccgaggtgaagaagcctggcgccagcgtgaaggtgagctgcaaggtgagcggcttcaacatcgaggactactacatgcactgggtgaggcaggctcctggcaagggcctggagtggatgggctggatcgaccccgtgaacggcgacaccgagtacgcccagaagttccagggcagggtgaccatgaccgccgacaccagcaccgacaccgcctacatggagctgagctccctgaggagcgaggacaccgccgtgtactactgcgctacctacgacggctacctgttcgccttctggggccagggcaccctggtgacagtgtccagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 385 - protein, 444 aa, Artificial Sequence
  Description of Artificial Sequence: Synthetic polypeptide
QVQLVQSGAEVKKPGASVKVSCKVSGFNIEDYYMHWVRQAPGKGLEWMGWIDPVNGDTEYAQKFQGRVTMTADTSTDTAYMELSSLRSEDTAVYYCATYDGYLFAFWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 386 - DNA, 1392 bp, Artificial Sequence
  Description of Artificial Sequence: Synthetic polynucleotide
atggagtggagctgggtgttcctgttcttcctgagcgtgaccaccggcgtgcacagccaggtgcagctggtgcagagcggagccgaggtgaagaagcctggcgccagcgtgaaggtgagctgcaaggtgagcggcttcaacatcgaggactactacatgcactgggtgaggcaggctcctggcaagggcctggagtggatgggctggatcgaccccgtgaacggcgacaccgagtacgcccagaagttccagggcagggtgaccatgaccgccgacaccagcaccgacaccgcctacatggagctgagctccctgaggagcgaggacaccgccgtgtactactgcaacttctacgacggctacctgttcgccttctggggccagggcaccctggtgacagtgtccagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 387 - protein, 444 aa, Artificial Sequence
  Description of Artificial Sequence: Synthetic polypeptide
QVQLVQSGAEVKKPGASVKVSCKVSGFNIEDYYMHWVRQAPGKGLEWMGWIDPVNGDTEYAQKFQGRVTMTADTSTDTAYMELSSLRSEDTAVYYCNFYDGYLFAFWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 388 - DNA, 1386 bp, Artificial Sequence
  Description of Artificial Sequence: Synthetic polynucleotide
atggagtggagctgggtgttcctgttcttcctgagcgtgaccaccggcgtgcacagccaggtgcagctggtgcagagcggcgctgaggtgaagaaacccggcgccagcgtgaaggtgagctgcaaggccagcggcttcaacatcgaggactactacatgcactgggtcagacaggcccctggccagagactggagtggatgggctggatcgaccctgtgaatggcgacaccgagtacagccagaagttccagggcagggtgaccatcacagccgacaccagcgccagcaccgcctacatggagctgagcagcctgaggagcgaggacaccgccgtgtactactgtgctcgttacgacggctacctgttcgccttctggggccagggcaccctggtgacagtgagcagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 389 - protein, 444 aa, Artificial Sequence
  Description of Artificial Sequence: Synthetic polypeptide
QVQLVQSGAEVKKPGASVKVSCKASGFNIEDYYMHWVRQAPGQRLEWMGWIDPVNGDTEYSQKFQGRVTITADTSASTAYMELSSLRSEDTAVYYCARYDGYLFAFWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 390 - DNA, 1392 bp, Artificial Sequence
  Description of Artificial Sequence: Synthetic polynucleotide
atggagtggagctgggtgttcctgttcttcctgagcgtgaccaccggcgtgcacagccaggtgcagctggtgcagagcggcgctgaggtgaagaaacccggcgccagcgtgaaggtgagctgcaaggccagcggcttcaacatcgaggactactacatgcactgggtcagacaggcccctggccagagactggagtggatgggctggatcgaccctgtgaatggcgacaccgagtacagccagaagttccagggcagggtgaccatcacagccgacaccagcgccagcaccgcctacatggagctgagcagcctgaggagcgaggacaccgccgtgtactactgtaacttctacgacggctacctgttcgccttctggggccagggcaccctggtgacagtgagcagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 391 - protein, 444 aa, Artificial Sequence
  Description of Artificial Sequence: Synthetic polypeptide
QVQLVQSGAEVKKPGASVKVSCKASGFNIEDYYMHWVRQAPGQRLEWMGWIDPVNGDTEYSQKFQGRVTITADTSASTAYMELSSLRSEDTAVYYCNFYDGYLFAFWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 392 - DNA, 1392 bp, Artificial Sequence
  Description of Artificial Sequence: Synthetic polynucleotide
atggagtggagctgggtgttcctgttcttcctgagcgtgaccaccggcgtgcacagcgaggtgcagctggtggagagcggaggagtggtggtgcagcctggcggaagcctgaggctgagctgtgccgcgagcggcttcaacatcgaggactactacatgcactgggtgagacaggcccccggcaaaggactggagtgggtgagctggatcgaccccgtgaatggcgacacagagtacgccgacagcgtgaagggcaggttcaccatcagcgccgacaacagcaagaacagcctgtacctgcagatgaacagcctgaggaccgaggataccgccctgtactactgcgctaagtacgacggctacctgttcgccttctggggacagggcaccctggtgaccgtgagcagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 393 - protein, 444 aa, Artificial Sequence
  Description of Artificial Sequence: Synthetic polypeptide
EVQLVESGGVVVQPGGSLRLSCAASGFNIEDYYMHWVRQAPGKGLEWVSWIDPVNGDTEYADSVKGRFTISADNSKNSLYLQMNSLRTEDTALYYCAKYDGYLFAFWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 394 - DNA, 1392 bp, Artificial Sequence
  Description of Artificial Sequence: Synthetic polynucleotide
atggagtggagctgggtgttcctgttcttcctgagcgtgaccaccggcgtgcacagcgaggtgcagctggtggagagcggaggagtggtggtgcagcctggcggaagcctgaggctgagctgtgccgcgagcggcttcaacatcgaggactactacatgcactgggtgagacaggcccccggcaaaggactggagtgggtgagctggatcgaccccgtgaatggcgacacagagtacgccgacagcgtgaagggcaggttcaccatcagcgccgacaacagcaagaacagcctgtacctgcagatgaacagcctgaggaccgaggataccgccctgtactactgcaacttctacgacggctacctgttcgccttctggggacagggcaccctggtgaccgtgagcagcgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 395 - protein, 444 aa, Artificial Sequence
  Description of Artificial Sequence: Synthetic polypeptide
EVQLVESGGVVVQPGGSLRLSCAASGFNIEDYYMHWVRQAPGKGLEWVSWIDPVNGDTEYADSVKGRFTISADNSKNSLYLQMNSLRTEDTALYYCNFYDGYLFAFWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 396 - DNA, 1392 bp, Artificial Sequence
  Description of Artificial Sequence: Synthetic polynucleotide
atggagtggagctgggtgttcctgttcttcctgagcgtgaccaccggcgtgcactcccaggtgcagctggtgcaaagcggcgccgaggtgaagaaacccggagccagcgtgaaggtgagctgcaaggcgagcggcttcaacatcgaggactactacatgcactgggtgagacaggccaccggccaaggcctggagtggatgggctggatcgaccccgtgaacggcgacaccgagtacgcccagaagttccagggcagggtgaccatgaccgccaacaccagcatcagcaccgcctacatggagctgagcagcctgaggagcgaggacaccgccgtgtactactgcgctcgttacgacggctacctgtttgccttctggggccagggcaccctggtgacagtgagctccgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 397 - protein, 444 aa, Artificial Sequence
  Description of Artificial Sequence: Synthetic polypeptide
QVQLVQSGAEVKKPGASVKVSCKASGFNIEDYYMHWVRQATGQGLEWMGWIDPVNGDTEYAQKFQGRVTMTANTSISTAYMELSSLRSEDTAVYYCARYDGYLFAFWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 398 - DNA, 1392 bp, Artificial Sequence
  Description of Artificial Sequence: Synthetic polynucleotide
atggagtggagctgggtgttcctgttcttcctgagcgtgaccaccggcgtgcactcccaggtgcagctggtgcaaagcggcgccgaggtgaagaaacccggagccagcgtgaaggtgagctgcaaggcgagcggcttcaacatcgaggactactacatgcactgggtgagacaggccaccggccaaggcctggagtggatgggctggatcgaccccgtgaacggcgacaccgagtacgcccagaagttccagggcagggtgaccatgaccgccaacaccagcatcagcaccgcctacatggagctgagcagcctgaggagcgaggacaccgccgtgtactactgcaacttctacgacggctacctgtttgccttctggggccagggcaccctggtgacagtgagctccgctagcaccaaaggcccctccgtgtttcctctggccccctgcagcagaagcaccagcgagagcacagccgctctgggctgcctggtcaaggactacttccccgagcccgtgacagtgagctggaatagcggcgccctgacatccggcgtgcataccttccctgccgtgctgcaaagctccggcctgtattccctgtcctccgtggtgacagtgcccagcagctccctgggaaccaagacctacacctgcaacgtggaccacaaacccagcaacaccaaggtggacaagagggtggaaagcaagtacggccctccttgccctccttgtcctgctcccgagttcctgggaggccccagcgtgttcctgttcccccctaagcccaaggacaccctcatgatctccaggacccccgaggtgacctgcgtggtggtggatgtgagccaggaagacccggaggtgcagttcaactggtacgtggacggcgtggaggtgcacaacgccaagaccaagcccagggaggagcagttcaacagcacctacagggtggtgtccgtcctgaccgtgctgcaccaggactggctgaacggcaaagagtacaagtgcaaggtgagcaacaagggcctgcccagctccatcgagaagacaatctccaaggccaagggccagcccagggaacctcaggtgtataccctgcctcccagccaggaggagatgaccaagaatcaggtgagcctgacctgcctggtgaaaggattctaccccagcgatatcgccgtggagtgggagagcaatggccagcccgagaacaactacaagaccacaccccccgtcctcgactccgatggctcctttttcctgtattccaggctcaccgtggacaagtccaggtggcaggaaggcaacgtgtttagctgcagcgtgatgcacgaggctctgcacaaccactatacacagaagagcctctccctgtccctcggcaagtga

SEQ ID NO: 399 - protein, 444 aa, Artificial Sequence
  Description of Artificial Sequence: Synthetic polypeptide
QVQLVQSGAEVKKPGASVKVSCKASGFNIEDYYMHWVRQATGQGLEWMGWIDPVNGDTEYAQKFQGRVTMTANTSISTAYMELSSLRSEDTAVYYCNFYDGYLFAFWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 400 - DNA, 720 bp, Artificial Sequence; identical to SEQ ID NO: 368
  Description of Artificial Sequence: Synthetic polynucleotide

SEQ ID NO: 401 - protein, 219 aa, Artificial Sequence; identical to SEQ ID NO: 369
  Description of Artificial Sequence: Synthetic polypeptide

SEQ ID NO: 402 - DNA, 720 bp, Artificial Sequence
  Description of Artificial Sequence: Synthetic polynucleotide
atgagcgtgcctacccaggtgctgggcctgctgctgctgtggctgaccgacgccaggtgcgacatcgtgatgacccagacccccctgagctcccctgtgacactgggccagcccgctagcatctcctgcaggagcagcaagagcctgctgcacagcgacggcaacacctacctgtactggctgcagcagagacctggccagcctcccaggctgctgatctacaggatgagcaacctggccagcggcgtgcccgatagattcagcggcagcggagccggcaccgacttcaccctgaagatcagcagagtggaggccgaggacgtgggcgtgtactactgcatgcagcacctggagtaccccttcaccttcggcggcggcaccaaggtggagatcaagcgtacggtggctgccccctccgtgttcatcttcccccccagcgatgagcagctgaagagcggcacagccagcgtggtgtgcctgctgaacaacttctaccccagggaggccaaggtgcagtggaaggtggacaacgccctgcagagcggcaacagccaggagtccgtgaccgagcaggacagcaaggacagcacctacagcctgagcagcacactgaccctgagcaaggccgactacgagaagcacaaggtgtacgcctgcgaggtgacccatcagggcctgagcagccccgtgaccaagagcttcaacaggggcgagtgctga

SEQ ID NO: 403 - protein, 219 aa, Artificial Sequence
  Description of Artificial Sequence: Synthetic polypeptide
DIVMTQTPLSSPVTLGQPASISCRSSKSLLHSDGNTYLYWLQQRPGQPPRLLIYRMSNLASGVPDRFSGSGAGTDFTLKISRVEAEDVGVYYCMQHLEYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 404 - DNA, 720 bp, Artificial Sequence
  Description of Artificial Sequence: Synthetic polynucleotide
atgtccgtgcctacccaggtgctgggcctgctgctgctgtggctgaccgacgctaggtgcgagatcgtgatgacccagacccccctgagcctgagcatcacccctggcgaacaggccagcatcagctgcaggagcagcaagagcctgctgcacagcgacggcaacacctacctgtactggttcctgcagaaggccaggcccgtgtccaccctgctgatctacaggatgtccaacctggccagcggcgtgcccgatagattcagcggctccggcagcggcacagacttcaccctgaagatcagcagggtggaggccgaggacttcggcgtgtactactgcatgcagcacctggagtaccctttcaccttcggcggcggcaccaaggtggagatcaagcgtacggtggctgccccctccgtgttcatcttcccccccagcgatgagcagctgaagagcggcacagccagcgtggtgtgcctgctgaacaacttctaccccagggaggccaaggtgcagtggaaggtggacaacgccctgcagagcggcaacagccaggagtccgtgaccgagcaggacagcaaggacagcacctacagcctgagcagcacactgaccctgagcaaggccgactacgagaagcacaaggtgtacgcctgcgaggtgacccatcagggcctgagcagccccgtgaccaagagcttcaacaggggcgagtgctga

SEQ ID NO: 405 - protein, 219 aa, Artificial Sequence
  Description of Artificial Sequence: Synthetic polypeptide
EIVMTQTPLSLSITPGEQASISCRSSKSLLHSDGNTYLYWFLQKARPVSTLLIYRMSNLASGVPDRFSGSGSGTDFTLKISRVEAEDFGVYYCMQHLEYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 406 - protein, 119 aa, Artificial Sequence
  Description of Artificial Sequence: Synthetic polypeptide
EVQLVQSGAEVKKPGASVKVSCKASGYTFTDYNVDWVRQAPGQGLEWMGDINPNNGGTIYSQKFKGRVTMTTDTSTSTAYMELRSLRSDDTAVYYCARNYRWFGAMDHWGQGTTVTVSS

SEQ ID NO: 407 - protein, 119 aa, Artificial Sequence
  Description of Artificial Sequence: Synthetic polypeptide
EVQLVQSGAEVKKPGASVKVSCKASGYTFTDYNVDWVRQAPGQGLEWMGDINPNNGGTIYSQKFKGRVTMTTDTSTSTAYMELRSLRSDDTAVYFCARNYRWFGAMDHWGQGTTVTVSS

SEQ ID NO: 408 - protein, 119 aa, Artificial Sequence
  Description of Artificial Sequence: Synthetic polypeptide
EVQLVQSGAEVKKPGASVKVSCKASGYTFTDYNVDWVRQAPGQGLEWIGDINPNNGGTIYSQKFKGRVTMTTDTSTSTAYMELRSLRSDDTAVYFCARNYRWFGAMDHWGQGTTVTVSS

SEQ ID NO: 409 - protein, 119 aa, Artificial Sequence
  Description of Artificial Sequence: Synthetic polypeptide
EVQLVQSGAEVKKPGASVKVSCKASGYTFTDYNVDWVRQAPGQGLEWIGDINPNNGGTIYSQKFKGRVTMTVDTSTSTAYMELRSLRSDDTAVYFCARNYRWFGAMDHWGQGTTVTVSS

SEQ ID NO: 410 - protein, 119 aa, Artificial Sequence
  Description of Artificial Sequence: Synthetic polypeptide
EVQLVQSGAEVKKPGASVKVSCKASGYTFTDYNVDWVRQAPGQGLEWIGDINPNNGGTIYSQKFKGRVTLTVDKSTSTAYMELRSLRSDDTAVYFCARNYRWFGAMDHWGQGTTVTVSS

SEQ ID NO: 411 - protein, 119 aa, Artificial Sequence
  Description of Artificial Sequence: Synthetic polypeptide
EVQLVQSGAEVKKPGASVKVSCKASGYTFTDYNVDWVRQAPGQGLEWIGDINPNNGGTIYSQKFKGKATLTVDKSTSTAYMELRSLRSDDTAVYFCARNYRWFGAMDHWGQGTTVTVSS

SEQ ID NO: 412 - protein, 109 aa, Artificial Sequence
  Description of Artificial Sequence: Synthetic polypeptide
QVQLVQSGAEVKKPGASVKVSCKASGYTFTSYGISWVRQAPGQGLEWMGWISAYNGNTNYAQKLQGRVTMTTDTSTSTAYMELRSLRSDDTAVYYCARWGQGTTVTVSS

SEQ ID NO: 413 - protein, 119 aa, Artificial Sequence
  Description of Artificial Sequence: Synthetic polypeptide
EVQLVQSGAEVKKPGASVKVSCKASGYTFTDYNVDWVRQAPGQGLEWMGDINPNNGGTIYSQKFKGRVTMTRDTSISTAYMELSRLRSDDTAVYYCARNYRWFGAMDHWGQGTTVTVSS

SEQ ID NO: 414 - protein, 119 aa, Artificial Sequence
  Description of Artificial Sequence: Synthetic polypeptide
EVQLVQSGAEVKKPGASVKVSCKASGYTFTDYNVDWVRQAPGQGLEWMGDINPNNGGTIYSQKFKGRVTMTRDTSISTAYMELRRLRSDDTAVYYCARNYRWFGAMDHWGQGTTVTVSS

SEQ ID NO: 415 - protein, 119 aa, Artificial Sequence
  Description of Artificial Sequence: Synthetic polypeptide
EVQLVQSGAEVKKPGASVKVSCKASGYTFTDYNVDWVRQAPGQGLEWMGDINPNNGGTIYSQKFKGRVTMTRDTSISTAYMELRRLRSDDTAVYFCARNYRWFGAMDHWGQGTTVTVSS

SEQ ID NO: 416 - protein, 119 aa, Artificial Sequence
  Description of Artificial Sequence: Synthetic polypeptide
EVQLVQSGAEVKKPGASVKVSCKASGYTFTDYNVDWVRQAPGQGLEWIGDINPNNGGTIYSQKFKGRVTMTRDTSISTAYMELRRLRSDDTAVYYCARNYRWFGAMDHWGQGTTVTVSS

SEQ ID NO: 417 - protein, 119 aa, Artificial Sequence
  Description of Artificial Sequence: Synthetic polypeptide
EVQLVQSGAEVKKPGASVKVSCKASGYTFTDYNVDWVRQAPGQGLEWIGDINPNNGGTIYSQKFKGRVTMTRDTSISTAYMELRRLRSDDTAVYFCARNYRWFGAMDHWGQGTTVTVSS

SEQ ID NO: 418 - protein, 119 aa, Artificial Sequence
  Description of Artificial Sequence: Synthetic polypeptide
EVQLVQSGAEVKKPGASVKVSCKASGYTFTDYNVDWVRQAPGQGLEWIGDINPNNGGTIYSQKFKGRVTMTVDTSISTAYMELRRLRSDDTAVYFCARNYRWFGAMDHWGQGTTVTVSS

SEQ ID NO: 419 - protein, 119 aa, Artificial Sequence; identical to SEQ ID NO: 418
  Description of Artificial Sequence: Synthetic polypeptide

SEQ ID NO: 420 - protein, 10 aa, Artificial Sequence
  Description of Artificial Sequence: Synthetic peptide
GFIIKATYMH

SEQ ID NO: 421 - protein, 17 aa, Artificial Sequence
  Description of Artificial Sequence: Synthetic peptide
RIDPANGETKYDPKFQV

SEQ ID NO: 422 - protein, 7 aa, Artificial Sequence
  Description of Artificial Sequence: Synthetic peptide
YAWYFDV

SEQ ID NO: 423 - protein, 11 aa, Artificial Sequence
  Description of Artificial Sequence: Synthetic peptide
RASENIYSFLA

SEQ ID NO: 424 - protein, 7 aa, Artificial Sequence
  Description of Artificial Sequence: Synthetic peptide
HAKTLAE

SEQ ID NO: 425 - protein, 9 aa, Artificial Sequence
  Description of Artificial Sequence: Synthetic peptide
QHYYGSPLT

SEQ ID NO: 426 - protein, 103 aa, Artificial Sequence
  Description of Artificial Sequence: Synthetic polypeptide
DIVMTQTPLSLSVTPGQPASISCKSSQSLLHSDGKTYLYWYLQKPGQPPQLLIYEVSNRFSGVPDRFSGSGSGTDFTLKISRVEAEDVGVYYCFGGGTKVEIK

SEQ ID NO: 427 - protein, 111 aa, Artificial Sequence
  Description of Artificial Sequence: Synthetic polypeptide
DIVMTQSPDSLAVSLGERATINCKASQSLDYEGDSDMNWYQQKPGQPPKLLIYGASNLESGVPDRFSGSGSGTDFTLTISSLQAEDVAVYYCQQSTEDPRTFGGGTKVEIK

SEQ ID NO: 428 - protein, 10 aa, Artificial Sequence
  Description of Artificial Sequence: Synthetic peptide
GYIFTDYAMH

SEQ ID NO: 429 - protein, 16 aa, Artificial Sequence
  Description of Artificial Sequence: Synthetic peptide
TFIPLLDTSDYNQNFK

SEQ ID NO: 430 - protein, 11 aa, Artificial Sequence
  Description of Artificial Sequence: Synthetic peptide
MGVTHSYVMDA

SEQ ID NO: 431 - protein, 11 aa, Artificial Sequence
  Description of Artificial Sequence: Synthetic peptide
RASQPISISVH

SEQ ID NO: 432 - protein, 7 aa, Artificial Sequence
  Description of Artificial Sequence: Synthetic peptide
FASQSIS

SEQ ID NO: 433 - protein, 9 aa, Artificial Sequence
  Description of Artificial Sequence: Synthetic peptide
QQTFSLPYT

SEQ ID NO: 434 - protein, 119 aa, Artificial Sequence
  Description of Artificial Sequence: Synthetic polypeptide
EVLLLQSGPELVKPGTSVKIPCKASGYTFTDYNVDWVKQRHGKGLEWIGDINPNEGGTIYSQKFKGKATLTVDKSSSTAFMELRSLTSEDTAVYFCARNYRWFGAMDHWGQGTSVTVSS

SEQ ID NO: 435 - protein, 119 aa, Artificial Sequence
  Description of Artificial Sequence: Synthetic polypeptide
EVLLLQSGPELVKPGTSVKIPCKASGYTFTDYNVDWVKQRHGKGLEWIGDINPNFGGTIYSQKFKGKATLTVDKSSSTAFMELRSLTSEDTAVYFCARNYRWFGAMDHWGQGTSVTVSS

SEQ ID NO: 436 - protein, 119 aa, Artificial Sequence
  Description of Artificial Sequence: Synthetic polypeptide
EVLLLQSGPELVKPGTSVKIPCKASGYTFTDYNVDWVKQRHGKGLEWIGDINPNLGGTIYSQKFKGKATLTVDKSSSTAFMELRSLTSEDTAVYFCARNYRWFGAMDHWGQGTSVTVSS

SEQ ID NO: 437 - protein, 119 aa, Artificial Sequence
  Description of Artificial Sequence: Synthetic polypeptide
EVLLLQSGPELVKPGTSVKIPCKASGYTFTDYNVDWVKQRHGKGLEWIGDINPNTGGTIYSQKFKGKATLTVDKSSSTAFMELRSLTSEDTAVYFCARNYRWFGAMDHWGQGTSVTVSS

SEQ ID NO: 438 - protein, 119 aa, Artificial Sequence
  Description of Artificial Sequence: Synthetic polypeptide
EVLLLQSGPELVKPGTSVKIPCKASGYTFTDYNVDWVKQRHGKGLEWIGDINPNVGGTIYSQKFKGKATLTVDKSSSTAFMELRSLTSEDTAVYFCARNYRWFGAMDHWGQGTSVTVSS

SEQ ID NO: 439 - protein, 119 aa, Artificial Sequence
  Description of Artificial Sequence: Synthetic polypeptide
EVLLLQSGPELVKPGTSVKIPCKASGYTFTDYNVDWVKQRHGKGLEWIGDINPNNGGTIYSQKFKGKATLTVDKSSSTAFMELRSLTSEDTAVYFCARNYRFFGAMDHWGQGTSVTVSS

SEQ ID NO: 440 - protein, 119 aa, Artificial Sequence
  Description of Artificial Sequence: Synthetic polypeptide
EVLLLQSGPELVKPGTSVKIPCKASGYTFTDYNVDWVKQRHGKGLEWIGDINPNNGGTIYSQKFKGKATLTVDKSSSTAFMELRSLTSEDTAVYFCARNYRIFGAMDHWGQGTSVTVSS

SEQ ID NO: 441 - protein, 119 aa, Artificial Sequence
  Description of Artificial Sequence: Synthetic polypeptide
EVLLLQSGPELVKPGTSVKIPCKASGYTFTDYNVDWVKQRHGKGLEWIGDINPNNGGTIYSQKFKGKATLTVDKSSSTAFMELRSLTSEDTAVYFCARNYRLFGAMDHWGQGTSVTVSS

SEQ ID NO: 442 - protein, 119 aa, Artificial Sequence
  Description of Artificial Sequence: Synthetic polypeptide
EVLLLQSGPELVKPGTSVKIPCKASGYTFTDYNVDWVKQRHGKGLEWIGDINPNNGGTIYSQKFKGKATLTVDKSSSTAFMELRSLTSEDTAVYFCARNYRVFGAMDHWGQGTSVTVSS

SEQ ID NO: 443 - protein, 525 aa, Homo sapiens
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 444 - protein, 521 aa, Mus musculus
MREDLLLGFLLLGLLWEAPVVSSGPGKELPVVWAQEGAPVHLPCSLKSPNLDPNFLRRGGVIWQHQPDSGQPTPIPALDLHQGMPSPRQPAPGRYTVLSVAPGGLRSGRQPLHPHVQLEERGLQRGDFSLWLRPALRTDAGEYHATVRLPNRALSCSLRLRVGQASMIASPSGVLKLSDWVLLNCSFSRPDRPVSVHWFQGQNRVPVYNSPRHFLAETFLLLPQVSPLDSGTWGCVLTYRDGFNVSITYNLKVLGLEPVAPLTVYAAEGSRVELPCHLPPGVGTPSLLIAKWTPPGGGPELPVAGKSGNFTLHLEAVGLAQAGTYTCSIHLQGQQLNATVTLAVITVTPKSFGLPGSRGKLLCEVTPASGKERFVWRPLNNLSRSCPGPVLEIQEARLLAERWQCQLYEGQRLLGATVYAAESSSGAHSARRISGDLKGGHLVLVLILGALSLFLLVAGAFGFHWWRKQLLLRRFSALEHGIQPFPAQRKIEELERELETEMGQEPEPEPEPQLEPEPRQL

SEQ ID NO: 445 - protein, 533 aa, Macaca fascicularis
  MOD_RES (74)..(74): Any amino acid
MWEAQFLGLLFLQPLWVAPVKPPQPGAEISVVWAQEGAPAQLPCSPTIPLQDLSLLRRAGVTWQHQPDSGPPAXAPGHPPVPGHRPAAPYSWGPRPRRYTVLSVGPGGLRSGRLPLQPRVQLDERGRQRGDFSLWLRPARRADAGEYRATVHLRDRALSCRLRLRVGQASMTASPPGSLRTSDWVILNCSFSRPDRPASVHWFRSRGQGRVPVQGSPHHHLAESFLFLPHVGPMDSGLWGCILTYRDGFNVSIMYNLTVLGLEPATPLTVYAGAGSRVELPCRLPPAVGTQSFLTAKWAPPGGGPDLLVAGDNGDFTLRLEDVSQAQAGTYICHIRLQGQQLNATVTLAIITVTPKSFGSPGSLGKLLCEVTPASGQEHFVWSPLNTPSQRSFSGPWLEAQEAQLLSQPWQCQLHQGERLLGAAVYFTELSSPGAQRSGRAPGALRAGHLPLFLILGVLFLLLLVTGAFGFHLWRRQWRPRRFSALEQGIHPPQAQSKIEELEQEPELEPEPELERELGPEPEPGPEPEPEQL

SEQ ID NO: 446 - protein, 17 aa, Artificial Sequence
  Description of Artificial Sequence: Synthetic peptide
  MOD_RES (6)..(6): Asp, Asn, Ser or Gln
  MOD_RES (12)..(12): Ala or Ser
  MOD_RES (16)..(16): Gln or Lys
  MOD_RES (17)..(17): Glu or Gly
DINPNXGGTIYXQKFXX

SEQ ID NO: 447 - protein, 441 aa, Artificial Sequence
  Description of Artificial Sequence: Synthetic polypeptide
LQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLHHHHHHHHHGGQ

SEQ ID NO: 448 - protein, 119 aa, Artificial Sequence
  Description of Artificial Sequence: Synthetic polypeptide
EVQLVQSGAEVKKPGASVKVSCKASGYTFTDYNVDWVRQAPGQGLEWIGDINPNNGGTIYSQKFKGRVTLTVDKSISTAYMELRRLRSDDTAVYFCARNYRWFGAMDHWGQGTTVTVSS

SEQ ID NO: 449 - protein, 109 aa, Artificial Sequence
  Description of Artificial Sequence: Synthetic polypeptide
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARWGQGTTVTVSS

SEQ ID NO: 450 - protein, 111 aa, Artificial Sequence
  Description of Artificial Sequence: Synthetic polypeptide
DIVMTQTPLSLSVTPGQPASISCKASQSLDYEGDSDMNWYLQKPGQPPQLLIYGASNLESGVPDRFSGSGSGTDFTLKISRVEAEDVGVYYCQQSTEDPRTFGGGTKVEIK

SEQ ID NO: 451 - protein, 111 aa, Artificial Sequence
  Description of Artificial Sequence: Synthetic polypeptide
DIVMTQTPLSLSVTPGQPASISCKASQSLDYEGDSDMNWYLQKPGQPPQLLISGASNLESGVPDRFSGSGSGTDFTLKISRVEAEDVGVYYCQQSTEDPRTFGGGTKVEIK

SEQ ID NO: 452 - protein, 111 aa, Artificial Sequence
  Description of Artificial Sequence: Synthetic polypeptide
DIVLTQTPLSLSVTPGQPASISCKASQSLDYEGDSDMNWYLQKPGQPPQLLISGASNLESGVPDRFSGSGSGTDFTLKISRVEAEDVGVYYCQQSTEDPRTFGGGTKVEIK

SEQ ID NO: 453 - protein, 111 aa, Artificial Sequence
  Description of Artificial Sequence: Synthetic polypeptide
DIVLTQTPLSLSVTPGQPASISCKASQSLDYEGDSDMNWYLQKPGQPPQLLISGASNLESGIPDRFSGSGSGTDFTLKISRVEAEDVGVYYCQQSTEDPRTFGGGTKVEIK

SEQ ID NO: 454 - protein, 17 aa, Artificial Sequence
  Description of Artificial Sequence: Synthetic peptide
DINPNGGGTIYAQKFQE

SEQ ID NO: 455 - protein, 17 aa, Artificial Sequence
  Description of Artificial Sequence: Synthetic peptide
DINPNQGGTIYAQKFQE

SEQ ID NO: 456 - protein, 17 aa, Artificial Sequence
  Description of Artificial Sequence: Synthetic peptide
DINPNSGGTIYAQKFQE

SEQ ID NO: 457 - protein, 17 aa, Artificial Sequence
  Description of Artificial Sequence: Synthetic peptide
DINPNDGGTIYAQKFQE

SEQ ID NO: 458 - protein, 17 aa, Artificial Sequence
  Description of Artificial Sequence: Synthetic peptide
DINPNNGGTIYAQKFQE

SEQ ID NO: 459 - protein, 111 aa, Artificial Sequence
  Description of Artificial Sequence: Synthetic polypeptide
DIVMTQSPDSLAVSLGERATINCKASQSLDYEGDSDMNWYQQKPGQPPKLLISGASNLESGVPDRFSGSGSGTDFTLTISSLQAEDVAVYYCQQSTEDPRTFGGGTKVEIK

SEQ ID NO: 460 - protein, 111 aa, Artificial Sequence
  Description of Artificial Sequence: Synthetic polypeptide
DIVLTQSPDSLAVSLGERATINCKASQSLDYEGDSDMNWYQQKPGQPPKLLISGASNLESGVPDRFSGSGSGTDFTLTISSLQAEDVAVYYCQQSTEDPRTFGGGTKVEIK

SEQ ID NO: 461 - protein, 111 aa, Artificial Sequence
  Description of Artificial Sequence: Synthetic polypeptide
DIVLTQSPDSLAVSLGERATINCKASQSLDYEGDSDMNWYQQKPGQPPKLLISGASNLESGIPDRFSGSGSGTDFTLTISSLQAEDVAVYYCQQSTEDPRTFGGGTKVEIK

SEQ ID NO: 462 - protein, 117 aa, Artificial Sequence
  Description of Artificial Sequence: Synthetic polypeptide
QLVQSGPEVKKPGTSVKVSCKASGYTFTDYNVDWVRQARGQRLEWIGDINPNDGGTIYAQKFQERVTITVDKSTSTAYMELSSLRSEDTAVYYCARNYRWFGAMDHWGQGTTVTVSS

SEQ ID NO: 463 - protein, 117 aa, Artificial Sequence
  Description of Artificial Sequence: Synthetic polypeptide
QLVQSGPEVKKPGTSVKVSCKASGYTFTDYNVDWVRQARGQRLEWIGDINPNGGGTIYAQKFQERVTITVDKSTSTAYMELSSLRSEDTAVYYCARNYRWFGAMDHWGQGTTVTVSS

SEQ ID NO: 464 - protein, 119 aa, Artificial Sequence
  Description of Artificial Sequence: Synthetic polypeptide
EVLLLQSGPELVKPGTSVKIPCKASGYTFTDYNVDWVKQRHGKGLEWIGDINPNQGGTIYSQKFKGKATLTVDKSSSTAFMELRSLTSEDTAVYFCARNYRWFGAMDHWGQGTSVTVSS

SEQ ID NO: 465 - protein, 11 aa, Artificial Sequence
  Description of Artificial Sequence: Synthetic peptide
KTSQNIFENLA

SEQ ID NO: 466 - protein, 7 aa, Artificial Sequence
  Description of Artificial Sequence: Synthetic peptide
NASPLQA

SEQ ID NO: 467 - protein, 8 aa, Artificial Sequence
  Description of Artificial Sequence: Synthetic peptide
HQYYSGYT

SEQ ID NO: 468 - protein, 10 aa, Artificial Sequence
  Description of Artificial Sequence: Synthetic peptide
GFTFSDYHMA

SEQ ID NO: 469 - protein, 17 aa, Artificial Sequence
  Description of Artificial Sequence: Synthetic peptide
SITLDATYTYYRDSVRG

SEQ ID NO: 470 - protein, 10 aa, Artificial Sequence
  Description of Artificial Sequence: Synthetic peptide
HRGFSVWLDY

We claim:

1. An antibody or antigen-binding fragment thereof that specifically binds human LAG3 comprising:
a light chain variable domain comprising:
CDR-L1 that comprises the amino acid sequence: KASQSLDYEGDSDMN (SEQ ID NO: 38);
CDR-L2 that comprises the amino acid sequence: GASNLES (SEQ ID NO: 39); and
CDR-L3 that comprises the amino acid sequence: QQSTEDPRT (SEQ ID NO: 40); and
a heavy chain variable domain comprising:
CDR-H1 that comprises the amino acid sequence: DYNVD (SEQ ID NO: 33);
CDR-H2 that comprises the amino acid sequence: DINPNDGGTIYAQKFQE (SEQ ID NO: 457); and
CDR-H3 that comprises the amino acid sequence: NYRWFGAMDH (SEQ ID NO: 35).

2. The antibody or antigen-binding fragment of claim 1 comprising one or more of CHO N-linked glycans selected from the group consisting of G0-F, G1-F, G2-F, G0, G1, G2 and Man5.

3. The antibody or antigen-binding fragment of claim 1 which is an antibody.

4. A composition comprising the antibody or antigen-binding fragment of claim 1 and a pharmaceutically acceptable carrier or diluent.

5. A vaccine comprising an antigen and a pharmaceutically acceptable carrier in association with an antibody or antigen-binding fragment of claim 1.

6. A vessel or injection device comprising the antibody or antigen-binding fragment of claim 1.

7. An antibody or antigen-binding fragment thereof that specifically binds human LAG3 comprising: a light chain variable domain comprising amino acids 21-131 of SEQ ID NO: 126 ; and a heavy chain variable domain comprising amino acids 1-119 of SEQ ID NO: 116.

8. An antibody comprising: a light chain comprising the amino acid sequence set forth in amino acids 21-238 of SEQ ID NO: 126 ; and a heavy chain comprising the amino acid sequence set forth in SEQ ID NO: 116.

9. The antibody or antigen-binding fragment of claim 1 that is expressed from a Chinese hamster ovary cell.

10. The antibody or antigen-binding fragment of claim 7 that is expressed from a Chinese hamster ovary cell.

11. The antibody of claim 8 that is expressed from a Chinese hamster ovary cell.

12. An antibody that consists of two heavy chains and two light chains, wherein each light chain comprises the amino acid sequence set forth in amino acids 21-238 of SEQ ID NO: 126 and each heavy chain comprises the amino acid sequence set forth in amino acids 1-119 of SEQ ID NO: 116 and a human IgG4 constant domain.

13. An antibody that consists of two heavy chains and two light chains, wherein each light chain comprises the amino acid sequence set forth in amino acids 21-238 of SEQ ID NO: 126 and each heavy chain comprises the amino acid sequence set forth in SEQ ID NO: 116.

14. An antibody that consists of two heavy chains and two light chains, wherein each light chain consists of the amino acid sequence set forth in amino acids 21-238 of SEQ ID NO: 126 and each heavy chain consists of the amino acid sequence set forth in SEQ ID NO: 116.

15. The antibody or antigen-binding fragment of claim 7 that is an antibody comprising a light chain comprising the amino acid sequence set forth in amino acids 21-238 of SEQ ID NO: 126 and a heavy chain comprising the amino acid sequence set forth in SEQ ID NO: 110.

16. The antibody of claim 12 that is expressed from a Chinese hamster ovary cell.

17. The antibody of claim 13 that is expressed from a Chinese hamster ovary cell.

18. The antibody of claim 14 that is expressed from a Chinese hamster ovary cell.

19. The antibody of claim 15 that is expressed from a Chinese hamster ovary cell.

20. The antibody or antigen binding fragment of claim 1 that is humanized.

21. A composition comprising:
a) an antibody or antigen binding fragment comprising: a light chain variable domain comprising amino acids 21-131 of SEQ ID NO: 126; and a heavy chain variable domain comprising amino acids 1-119 of SEQ ID NO: 116; and
b) pembrolizumab.

22. A composition comprising:
a) an antibody comprising a light chain comprising the amino acid sequence set forth in amino acids 21-238 of SEQ ID NO: 126 and a heavy chain comprising the amino acid sequence set forth in SEQ ID NO: 116; and
b) pembrolizumab.

23. A composition comprising:
a) an antibody that consists of two heavy chains and two light chains, wherein each light chain comprises the amino acid sequence set forth in amino acids 21-238 of SEQ ID NO: 126 and each heavy chain comprises the amino acid sequence set forth in amino acids 1-119 of SEQ ID NO: 116 and a human IgG4 constant domain; and
b) pembrolizumab.

24. A composition comprising:
a) an antibody that consists of two heavy chains and two light chains, wherein each light chain comprises the amino acid sequence set forth in amino acids 21-238 of SEQ ID NO: 126 and each heavy chain comprises the amino acid sequence set forth in SEQ ID NO: 116; and
b) pembrolizumab.

25. A composition comprising:
a) an antibody that consists of two heavy chains and two light chains, wherein each light chain consists of the amino acid sequence set forth in amino acids 21-238 of SEQ ID NO: 126 and each heavy chain consists of the amino acid sequence set forth in SEQ ID NO: 116; and
b) pembrolizumab.

26. A kit comprising the antibody or antigen-binding fragment of claim 7 and pembrolizumab.

27. A kit comprising the antibody of claim 8 and pembrolizumab.

28. A kit comprising the antibody of claim 12 and pembrolizumab.

29. A kit comprising the antibody of claim 13 and pembrolizumab.

30. A kit comprising the antibody of claim 14 and pembrolizumab.

31. An antibody that consists of two heavy chains and two light chains, wherein each light chain consists of the amino acid sequence set forth in amino acids 21-238 of SEQ ID NO: 126 and each heavy chain consists of the amino acid sequence set forth in amino acids 1-119 of SEQ ID NO: 116 and a human IgG4 constant region with a S228P mutation according to the EU system.

32. An antibody that consists of two heavy chains and two light chains, wherein each light chain consists of the amino acid sequence set forth in amino acids 21-238 of SEQ ID NO: 126 and each heavy chain consists of the amino acid sequence set forth in amino acids 1-119 of SEQ ID NO: 116 and a human IgG4 constant region.

33. An antibody that consists of two heavy chains and two light chains, wherein each light chain consists of the amino acid sequence set forth in amino acids 21-238 of SEQ ID NO: 126 and each heavy chain comprises the amino acid sequence set forth in amino acids 1-119 of SEQ ID NO: 116.

34. The antibody of claim 31 that is expressed from a Chinese hamster ovary cell.

35. The antibody of claim 32 that is expressed from a Chinese hamster ovary cell.

36. The antibody of claim 33 that is expressed from a Chinese hamster ovary cell.

37. A kit comprising the antibody of claim 31 and pembrolizumab.

38. A kit comprising the antibody of claim 32 and pembrolizumab.

39. A kit comprising the antibody of claim 33 and pembrolizumab.

40. A composition comprising:
a) an antibody that consists of two heavy chains and two light chains, wherein each light chain consists of the amino acid sequence set forth in amino acids 21-238 of SEQ ID NO: 126 and each heavy chain comprises the amino acid sequence set forth in amino acids 1-119 of SEQ ID NO: 116; and
b) pembrolizumab.

41. A composition comprising:
a) an antibody that consists of two heavy chains and two light chains, wherein each light chain consists of the amino acid sequence set forth in amino acids 21-238 of SEQ ID NO: 126 and each heavy chain consists of the amino acid sequence set forth in amino acids 1-119 of SEQ ID NO: 116 and a human IgG4 constant region with a S228P mutation according to the EU system; and
b) pembrolizumab.

* * * * *